US007348410B2

(12) United States Patent
Gaines et al.

(10) Patent No.: US 7,348,410 B2
(45) Date of Patent: Mar. 25, 2008

(54) FLEA HEAD, NERVE CORD, HINDGUT AND MALPIGHIAN TUBULE PROTEINS

(75) Inventors: Patrick J. Gaines, Fort Collins, CO (US); Nancy Wisnewski, Fort Collins, CO (US)

(73) Assignee: Heska Corporation, Loveland, CO (US)

( * ) Notice: Subject to any disclaimer, the term of this patent is extended or adjusted under 35 U.S.C. 154(b) by 234 days.

(21) Appl. No.: 10/978,245

(22) Filed: Oct. 29, 2004

(65) Prior Publication Data

US 2005/0239103 A1 Oct. 27, 2005

Related U.S. Application Data

(60) Continuation of application No. 09/991,936, filed on Nov. 21, 2001, now abandoned, which is a division of application No. 09/543,668, filed on Apr. 7, 2000, now abandoned.

(60) Provisional application No. 60/128,704, filed on Apr. 9, 1999.

(51) Int. Cl.
| | |
|---|---|
| *C07K 1/00* | (2006.01) |
| *C07K 14/00* | (2006.01) |
| *C07K 17/00* | (2006.01) |
| *G01N 33/53* | (2006.01) |

(52) U.S. Cl. ........................ 530/350; 435/7.1
(58) Field of Classification Search .................. None
See application file for complete search history.

(56) References Cited

U.S. PATENT DOCUMENTS 6,150,135 A * 11/2000 Chandrashekar et al. .. 435/69.3
6,703,491 B1 * 3/2004 Homburger et al. ....... 536/23.1

OTHER PUBLICATIONS

Stratagene Catalog, p. 39 (1988).*
Bajjalieh et al., 1993, *Proc. Natl. Acad Sci. USA*, vol. 90, pp. 2150-2154.
Barry et al., 1999, *Insect Biochemistry and Molecular Biology*, 29, pp. 319-327.
Bristow et al., 1996, *J Pharmacol Exp Ther*, 279(2), pp. 492-501.
Casu et al., 1997, *Proc. Natl. Acad. Sci. USA*, vol. 94, pp. 8939-8944.
East et al., 1993, *International Journal for Parasitology*, vol. 23, No. 2, pp. 221-229.
East et al., 1993, *Immunology and Cell Biology*, 71, pp. 453-462.
Eisemann et al., 1994, *International Journal for Parisitology*, vol. 24, No. 1, pp. 15-26.
Eisemann et al., 1993, *Medical and Veterinary Entomology*, 7, pp. 177-185.
Eldefrawi et al., 1987, *FASEB J.*, vol. 1, No. 4, pp. 262-271.
Elvin et al., 1996, *The Journal of Biological Chemistry*, vol. 271, No. 15, pp. 8925-8935.
Emery et al., 1998, *Journal of Insect Physiology*, 44, pp. 197-209.
Feany et al., 1992, *Cell*, vol. 70, pp. 861-867.
Fujiwara et al., 1995, *Biochem. J.*, 312, pp. 315-318.
Gready et al., 1997, *Protein Science*, 6, pp. 983-998.
Hayashi et al., 1994, *The Journal of Biological Chemistry*, vol. 269, No. 16, pp. 12269-12276.
Hendersen et al., 1994, *Insect Biochem. Molec. Biol.*, vol. 24, No. 4, pp. 363-371.
Hosie et al., 1997, *Trends Neurosci.*, vol. 20, pp. 578-583.
Ikeda et al., 1998, *NeuroReport*, vol. 9, No. 14, pp. 3189-3195.
Karp et al., 1993, *J Biol Chem*, 268(5), pp. 3728-3733.
Kim et al., 1998, *Biochem. J.*,330, pp. 295-302.
Koenderink et al., 1999, *The Journal of Biological Chemistry*, vol. 274, No. 17, pp. 11604-11610.
Landry et al., 1993, *The Journal of Biological Chemistry*, vol. 268, No. 20, pp. 14948-14955.
Ma et al., 1999, *Molecular Brain Research*, 63, pp. 217-224.
McKenna et al., 1994, *The Journal of Biological Chemistry*, vol. 269, No. 23, pp. 16340-16347.
O'Donnell et al, 1998, *American Journal of Physiology*, vol. 274, Issue 4, No. 2, pp. R1039-R1049.
Orgad et al., ,1998 *J Exp Biol*, 201, pp. 115-120.
Ozaki et al., 1995, *Eur. J. Biochem.*, 230, pp. 298-308.
Planells-Cases et al., 1993, *Proc Natl Acad Sci USA*, 90(11), pp. 5057-5061.
Pruett, J., 1999, *International Journal for Parasitology*, 29, pp. 25-32.
Ramasamy et al., 1996, *J. Med. Entomol.*, vol. 33, No. 1, pp. 162-164.
Ramasamy et al., 1997, *Biochimica et Biophysica Acta*, 1361, pp. 114-122.
Reeves et al., 1993, *Insect Biochem. Molec. Biol.*, vol. 23, No. 7, pp. 809-814.
Romanov et al., 1999, *Analytical Biochemistry*, 268, pp. 49-53.
Schnee et al., 1997, *The Journal of Experimental Biology*, 200, pp. 2947-2955.
Schorderet et al., 1998, *Insect Biochem. Molec. Biol.*, vol. 28, No. 2, pp. 99-111.
Schubert, K., 1981, *Plant Physiol.*, 68, pp. 1115-1122.

(Continued)

*Primary Examiner*—Teresa E. Strzelecka

(57) ABSTRACT

The present invention relates to flea head, nerve cord, hindgut and Malpighian tubule proteins; to flea head, nerve cord, hindgut and Malpighian tubule nucleic acid molecules, including those that encode such flea head, nerve cord, hindgut and Malpighian tubule proteins; to antibodies raised against such flea head, nerve cord, hindgut and Malpighian tubule proteins; and to compounds that inhibit flea head, nerve cord, hindgut and Malpighian tubule protein activity. The present invention also includes methods to obtain such proteins, nucleic acid molecules, antibodies, and inhibitory compounds. Also included in the present invention are therapeutic compositions comprising proteins, nucleic acid molecules, or protective compounds derived from proteins of the present invention as well as the use of such therapeutic compositions to protect animals from flea infestation. Also included in the present invention is the use of flea head, nerve cord, hindgut and Malpighian tubule proteins to derive inhibitory compounds.

4 Claims, No Drawings

OTHER PUBLICATIONS

Shen et al., 1998, *The Journal of Biological Chemistry*, vol. 273, No. 28, pp. 17665-17670.

Srikrishnaraj et al., 1995, *Medical and Veterinary Entomology*, 9, pp. 353-357.

Sun et al., 1998, *Journal of Neurochemistry*, vol. 71, No. 1, pp. 142-151.

Tellam et al., 1999, *Insect Biochemistry and Molecular Biology*, 29, pp. 87-101.

Thiemann et al., 1992, *Nature*, vol. 356, pp. 57-60.

Thymianou et al., 1998, *Insect Molecular Biology*, 7(4), pp. 345-353.

Tingley et al., 1993, *Nature*, vol. 364, pp. 70-73.

Usuda et al., 1994, *Journal of Cell Science*, 107, pp. 1073-1081.

Wang et al., 1998, *Archives of Biochemistry and Biophysics*, vol. 358, No. 1, pp. 116-124.

Wang et al., 1998, *Insect Molecular Biology*, 7(4), pp. 317-325.

Westphal et al.1999, *Cell*, vol. 96, pp. 689-700.

Wijffels et al.1999, *International Journal for Parasitology*, 29, pp. 1363-1377.

Younkin et al., 1993, *Proc Natl Acad Sci USA*, 90, pp. 2174-2178.

* cited by examiner

FLEA HEAD, NERVE CORD, HINDGUT AND MALPIGHIAN TUBULE PROTEINS

CROSS REFERENCE TO RELATED APPLICATIONS

This application is a Continuation of U.S. patent application Ser. No. 09/991,936, filed Nov. 21, 2001, now abandoned entitled "FLEA VOLTAGE-GATED CHLORIDE CHANNEL NUCLEIC ACID MOLECULES AND USES THEREOF"; which is a Divisional of U.S. patent application Ser. No. 09/543,668, filed Apr. 7, 2000, now abandoned entitled "FLEA ALLANTOINASE NUCLEIC ACID MOLECULES AND USES THEREOF": which claims priority to U.S. Provisional Patent Application Ser. No. 60/128,704, filed Apr. 9, 1999, entitled "NOVEL FLEA HEAD, NERVE CORD, HINDGUT AND MALPIGHIAN TUBULE NUCLEIC ACID MOLECULES, PROTEINS AND USES THEREOF".

FIELD OF THE INVENTION

The present invention relates to nucleic acid molecules isolated from the head and nerve cord of a flea, nucleic acid molecules isolated from the hindgut and Malpighian tubule of a flea, proteins encoded by such nucleic acid molecules, antibodies raised against such proteins, and inhibitors of such proteins. The present invention also includes therapeutic compositions comprising such nucleic acid molecules, proteins, antibodies, and/or other inhibitors, as well as uses thereof.

BACKGROUND OF THE INVENTION

Flea infestation of animals is a health and economic concern because fleas are known to cause and/or transmit a variety of diseases. Fleas directly cause a variety of diseases, including allergies, and also carry a variety of infectious agents including, but not limited to, endoparasites (e.g., nematodes, cestodes, trematodes and protozoa), bacteria and viruses. In particular, the bites of fleas are a problem for animals maintained as pets because the infestation becomes a source of annoyance not only for the pet but also for the pet owner who may find his or her home generally contaminated with insects. As such, fleas are a problem not only when they are on an animal but also when they are in the general environment of the animal.

Bites from fleas are a particular problem because they not only can lead to disease transmission but also can cause a hypersensitive response in animals which is manifested as disease. For example, bites from fleas can cause an allergic disease called flea allergic (or allergy) dermatitis (FAD). A hypersensitive response in animals typically results in localized tissue inflammation and damage, causing substantial discomfort to the animal.

The medical importance of flea infestation has prompted the development of reagents capable of controlling flea infestation. Commonly encountered methods to control flea infestation are generally focused on use of insecticides. While some of these products are efficacious, most, at best, offer protection of a very limited duration. Furthermore, many of the methods are often not successful in reducing flea populations. In particular, insecticides have been used to prevent flea infestation of animals by adding such insecticides to shampoos, powders, collars, sprays, spot-on formulations foggers and liquid bath treatments (i.e., dips). Reduction of flea infestation on the pet has been unsuccessful for one or more of the following reasons: failure of owner compliance (frequent administration is required); behavioral or physiological intolerance of the pet to the pesticide product or means of administration; and the emergence of flea populations resistant to the prescribed dose of pesticide.

Thus, there remains a need to develop a reagent and a method to protect animals from flea infestation.

SUMMARY OF THE INVENTION

The present invention relates to a novel product and process for protection of animals from flea infestation.

The present invention provides flea head and nerve cord (HNC) proteins and flea hindgut and Malpighian tubule (HMT) proteins; nucleic acid molecules encoding flea HNC proteins and flea HMT proteins; antibodies raised against such proteins (i.e., anti-flea HNC antibodies and anti-flea HMT antibodies respectively); mimetopes of such proteins or antibodies; and compounds that inhibit flea HNC or HMT activity (i.e, inhibitory compounds or inhibitors).

The present invention also includes methods to obtain such proteins, mimetopes, nucleic acid molecules, antibodies and inhibitory compounds. The present invention also includes the use of proteins and antibodies to identify such inhibitory compounds as well as assay kits to identify such inhibitory compounds. Also included in the present invention are therapeutic compositions comprising proteins, mimetopes, nucleic acid molecules, antibodies and inhibitory compounds of the present invention including protective compounds derived from a protein of the present invention that inhibit the activity of HNC and/or HMT proteins; also included are uses of such therapeutic compounds to reduce flea infestation.

One embodiment of the present invention is an isolated nucleic acid molecule that hybridizes with a nucleic acid sequence having SEQ ID NO:1, SEQ ID NO:3, SEQ ID NO:4, SEQ ID NO:6, SEQ ID NO:7, SEQ ID NO:9, SEQ ID NO:10, SEQ ID NO:12, SEQ ID NO:13, SEQ ID NO:15, SEQ ID NO:16, SEQ ID NO:18, SEQ ID NO:19, SEQ ID NO:21, SEQ ID NO:22, SEQ ID NO:24, SEQ ID NO:25, SEQ ID NO:27, SEQ ID NO:28, SEQ ID NO:30, SEQ ID NO:31, SEQ ID NO:33, SEQ ID NO:34, SEQ ID NO:36, SEQ ID NO:37, SEQ ID NO:39, SEQ ID NO:40, SEQ ID NO:42, SEQ ID NO:43, SEQ ID NO:45, SEQ ID NO:46, SEQ ID NO:48, SEQ ID NO:153, SEQ ID NO:155, SEQ ID NO:156, SEQ ID NO:158, SEQ ID NO:159, SEQ ID NO:161, SEQ D NO:162, SEQ ID NO:164, SEQ ID NO:165, SEQ ID NO:167, SEQ ID NO:168, SEQ ID NO:170, SEQ ID NO:1859, SEQ ID NO:1860, SEQ ID NO:1861, SEQ ID NO:1863, SEQ ID NO:1864, SEQ ID NO:1866, SEQ ID NO:1867, SEQ ID NO:1869, SEQ ID NO:1870, SEQ ID NO:1871, SEQ ID NO:1872, SEQ ID NO:1874, SEQ ID NO:1875, SEQ ID NO:1876, SEQ ID NO:1877, SEQ ID NO:1878, SEQ ID NO:1880, SEQ ID NO:1881, SEQ ID NO:1882, SEQ ID NO:1884, SEQ ID NO:1885, SEQ ID NO:1886, SEQ ID NO:1887, SEQ ID NO:1889, SEQ ID NO:1890, SEQ ID NO:1891, SEQ ID NO:1892, SEQ ID NO:1893, SEQ ID NO:1894, SEQ ID NO:1895, SEQ ID NO:1896, SEQ ID NO:1898, SEQ ID NO:1899, SEQ ID NO:1900, SEQ ID NO:1901, SEQ ID NO:1903, SEQ ID NO:1904, SEQ ID NO:1905, SEQ ID NO:1906, SEQ ID NO:1907, SEQ ID NO:1908, SEQ ID NO:1909, SEQ ID NO:1910, SEQ ID NO:1911, SEQ ID NO:1912, SEQ ID NO:1913, SEQ ID NO:1914, SEQ ID NO:1916, SEQ ID NO:1917, SEQ ID NO:1918, SEQ ID NO:1919, SEQ ID NO:1921, SEQ ID NO:1922, SEQ ID NO:1923, SEQ ID NO:1924, SEQ ID NO:1926, SEQ ID NO:1927, SEQ ID NO:1928, SEQ ID NO:1929, and/or SEQ ID NO:1931 under conditions that allow less than or equal to about 30% base pair mismatch. Another embodiment of the present invention is an isolated nucleic acid molecule that hybridizes with a nucleic acid molecule selected from the group consisting of a nucleic acid sequence of Table I, Table II, Table III and/or Table IV, or a nucleic acid sequence complementary to a nucleic acid sequence of Table I, Table II, Table III and/or Table IV under conditions that allow less than or equal to about 30% base pair mismatch.

Another embodiment of the present invention is an isolated nucleic acid molecule having nucleic acid sequence that is at least about 70% identical to SEQ ID NO:1, SEQ ID NO:3, SEQ ID NO:4, SEQ ID NO:6, SEQ ID NO:7, SEQ ID NO:9, SEQ ID NO:10, SEQ ID NO:12, SEQ ID NO:13, SEQ ID NO:15, SEQ ID NO:16, SEQ ID NO:18, SEQ ID NO:19, SEQ ID NO:21, SEQ ID NO:22, SEQ ID NO:24, SEQ ID NO:25, SEQ ID NO:27, SEQ ID NO:28, SEQ ID NO:30, SEQ ID NO:31, SEQ ID NO:33, SEQ ID NO:34, SEQ ID NO:36, SEQ ID NO:37, SEQ ID NO:39, SEQ ID NO:40, SEQ ID NO:42, SEQ ID NO:43, SEQ ID NO:45, SEQ ID NO:46, SEQ ID NO:48, SEQ ID NO:153, SEQ ID NO:155, SEQ ID NO:156, SEQ ID NO:158, SEQ ID NO:159, SEQ ID NO:161, SEQ ID NO:162, SEQ ID NO:164, SEQ ID NO:165, SEQ ID NO:167, SEQ ID NO:168, SEQ ID NO:170, SEQ ID NO:1859, SEQ ID NO:1860, SEQ ID NO:1861, SEQ ID NO:1863, SEQ ID NO:1864, SEQ ID NO:1866, SEQ ID NO:1867, SEQ ID NO:1869, SEQ ID NO:1870, SEQ ID NO:1871, SEQ ID NO:1872, SEQ ID NO:1874, SEQ ID NO:1875, SEQ ID NO:1876, SEQ ID NO:1877, SEQ ID NO:1878, SEQ ID NO:1880, SEQ ID NO:1881, SEQ ID NO:1882, SEQ ID NO:1884, SEQ ID NO:1885, SEQ ID NO:1886, SEQ ID NO:1887, SEQ ID NO:1889, SEQ ID NO:1890, SEQ ID NO:1891, SEQ ID NO:1892, SEQ ID NO:1893, SEQ ID NO:1894, SEQ ID NO:1895, SEQ ID NO:1896, SEQ ID NO:1898, SEQ ID NO:1899, SEQ ID NO:1900, SEQ ID NO:1901, SEQ ID NO:1903, SEQ ID NO:1904, SEQ ID NO:1905, SEQ ID NO:1906, SEQ ID NO:1907, SEQ ID NO:1908, SEQ ID NO:1909, SEQ ID NO:1910, SEQ ID NO:1911, SEQ ID NO:1912, SEQ ID NO:1913, SEQ ID NO:1914, SEQ ID NO:1916, SEQ ID NO:1917, SEQ ID NO:1918, SEQ ID NO:1919, SEQ ID NO:1921, SEQ ID NO:1922, SEQ ID NO:1923, SEQ ID NO:1924, SEQ ID NO:1926, SEQ ID NO:1927, SEQ ID NO:1928, SEQ ID NO:1929, and/or SEQ ID NO:1931 and/or a nucleic acid sequence of Table I, Table II, Table III and/or Table IV or complements thereof.

The present invention also relates to recombinant molecules, recombinant viruses and recombinant cells that include a nucleic acid molecule of the present invention. Also included are methods to produce such nucleic acid molecules, recombinant molecules, recombinant viruses and recombinant cells.

Another embodiment of the present invention includes an isolated flea HMT and/or HNC protein that is at least about 70% identical to an amino acid sequence selected from the group consisting of SEQ ID NO:2, SEQ ID NO:8, SEQ ID NO:14, SEQ ID NO:20, SEQ ID NO:26, SEQ ID NO:32, SEQ ID NO:38, SEQ ID NO:44, SEQ ID NO:154, SEQ ID NO:160, SEQ ID NO:163, SEQ ID NO:169, SEQ ID NO:1862, SEQ ID NO:1868, SEQ ID NO:1873, SEQ ID NO:1879, SEQ ID NO:1883, SEQ ID NO:1888, SEQ ID NO:1897, SEQ ID NO:1902, SEQ ID NO:1915, SEQ ID NO:1920, SEQ ID NO:1925, and/or SEQ ID NO:1930 and/or an amino acid sequence encoded by a nucleic acid sequence of Table I, Table II, Table III and/or Table IV, and fragments thereof, wherein such fragments can elicit an immune response against respective flea proteins or have activity comparable to respective flea proteins.

Another embodiment of the present invention includes an isolated protein encoded by a nucleic acid molecule that hybridizes with the complement of a nucleic acid sequence having SEQ ID NO:1, SEQ ID NO:4, SEQ ID NO:7, SEQ ID NO:10, SEQ ID NO:13, SEQ ID NO:16, SEQ ID NO:19, SEQ ID NO:22, SEQ ID NO:25, SEQ ID NO:28, SEQ ID NO:31, SEQ ID NO:34, SEQ ID NO:37, SEQ ID NO:40, SEQ ID NO:43, SEQ ID NO:46, SEQ ID NO:153, SEQ ID NO:156, SEQ ID NO:159, SEQ ID NO:162, SEQ ID NO:165, SEQ ID NO:168, SEQ ID NO:1859, SEQ ID NO:1861, SEQ ID NO:1864, SEQ ID NO:1867, SEQ ID NO:1870, SEQ ID NO:1872, SEQ ID NO:1875, SEQ ID NO:1877, SEQ ID NO:1878, SEQ ID NO:1881, SEQ ID NO:1882, SEQ ID NO:1885, SEQ ID NO:1887, SEQ ID NO:1890, SEQ ID NO:1892, SEQ ID NO:1894, SEQ ID NO:1896, SEQ ID NO:1899, SEQ ID NO:1901, SEQ ID NO:1904, SEQ ID NO:1906, SEQ ID NO:1908, SEQ ID NO:1910, SEQ ID NO:1912, SEQ ID NO:1914, SEQ ID NO:1917, SEQ ID NO:1919, SEQ ID NO:1922, SEQ ID NO:1924, SEQ ID NO:1927, and/or SEQ ID NO:1929 and/or a nucleic acid sequence of Table I, Table II, Table III and/or Table IV, under conditions that allow less than or equal to about 30% base pair mismatch.

DETAILED DESCRIPTION OF THE INVENTION

The present invention provides for nucleic acid molecules isolated from the head and/or nerve cord of a flea, nucleic acid molecules isolated from the hindgut and/or Malpighian tubule of a flea, proteins encoded by such nucleic acid molecules, antibodies raised against such proteins, and inhibitors of such proteins. As used herein, nucleic acid molecules isolated from the head and/or nerve cord of a flea and proteins encoded by such nucleic acid molecules are also referred to as flea HNC, or HNC, nucleic acid molecules and proteins respectively; and nucleic molecules isolated from the hindgut and/or Malpighian tubules of a flea and proteins encoded by such nucleic acid molecules are referred to as flea HMT or HMT, nucleic acid molecules and proteins respectively. HNC nucleic acid molecules and HMT nucleic acid molecules of the present invention are nucleic acid molecules that are primarily expressed in flea HNC tissues and HMT tissues respectively, but which may be expressed in cells derived from flea tissues other than HNC and HMT. HNC and HMT nucleic acid molecules and proteins of the present invention can be isolated from a flea or prepared recombinantly or synthetically. HMT and HNC nucleic acid molecules of the present invention can be RNA or DNA; examples of nucleic acid molecules include, but are not limited to, complementary DNA (cDNA) molecules, genomic DNA molecules, synthetic DNA molecules, DNA molecules which are specific tags for messenger RNA derived from HMT and HNC tissues, and corresponding mRNA molecules. As used herein, the phrases "HMT and/or HNC protein" and "HMT and HNC protein" refer to a protein expressed by a flea HMT tissue, by a flea HNC tissue, or by both flea HMT and HNC tissues. As used herein, the phrases "HMT and/or HNC nucleic acid molecule" and "HMT and HNC nucleic acid molecule" refer to a nucleic acid molecule that can be isolated from a HMT cDNA library, from a HNC cDNA library, or from both libraries, or a gene corresponding thereto.

The present invention provides for nucleic acid molecules containing partial or full-length coding regions that encode one or more of the following flea proteins: an allantoinase (ALN) protein, a chitin-binding protein (CBP) protein, a sodium/potassium ATPase beta subunit (NKAB) protein, a ligand-gated chloride channel (LGIC) protein, an ANON/23DA (ANON) protein, a malvolio (MALV) protein, an odorant-binding protein-like (OS-D) protein, a N-methyl-D-aspartate receptor associated (NMDA) protein, a chemical sense related lipophilic ligand binding protein-like (CLBP) protein, a Sodium/Hydrogen Transporter-like (NAH) protein, a Chloride Intracellular Channel-like (CLIC) protein, aPeritrophin-like (PL2) protein, aPeritrophin-like (PL3) protein, aPeritrophin-like (PL4) protein, a synaptic vesicle 2B-like (SVP) protein, a voltage-gated Chloride-like (VGCC) protein, an anoxia upregulated protein-like (AUP) protein, and a neuroendocrine specific 7B2-like (7B2) protein. Such nucleic acid molecules are referred to as ALN nucleic acid molecules, CBP nucleic acid molecules, NKAB nucleic acid molecules, LGIC nucleic acid molecules, ANON nucleic acid molecules, MALV nucleic acid molecules, OS-D nucleic acid molecules, NMDA nucleic acid molecules, CLBP nucleic acid molecules, NAH nucleic acid molecules, CLIC nucleic acid molecules, PL2 nucleic acid molecules, PL3 nucleic acid molecules, PL4 nucleic acid molecules, SVP nucleic acid molecules, VGCC nucleic acid molecules, AUP nucleic acid molecules, and 7B2 nucleic acid molecules respectively and are described herein in detail below.

Allantoinase is involved in the catalysis of the reaction converting allantoin to allantoic acid. This is a middle step in purine catabolism, which in insects results in the secretion of urea as the end product. The enzyme is located in the peroxisomes of the liver and kidney in amphibians. There is no known mammalian homologue to allantoinase, as mammals secrete uric acid, a precursor to allantoin. As such, flea allantoinase represents a novel target for anti-flea vaccines and chemotherapeutic drugs.

The function of chitin binding protein is largely unknown. A chitinase-like protein of *Bombyx mori* (GenBank accession # 1841851) is reported to have weak similarity with the chitin-binding domain of insect chitinases; however, it has no significant similarity to the catalytic regions of known chitinases, and therefore is not expected to have chitinase activity. The chitinase-like protein of *B. mori* is also similar to the peritrophin family of proteins located in the peritrophic matrix of insects. These proteins contain putative chitin-binding domains but have no other apparent homology to any known proteins. Without being bound by theory, it is believed that these proteins bind chitin and are a structural component of the peritrophic matrix. As such, flea chitin binding protein represents a novel target for anti-flea vaccines and chemotherapeutic drugs.

Na+/K+ATPase is involved in the hydrolysis of ATP to power the transport of Na+ out of and K+ into cells. It is responsible for establishing the Na+ gradient across plasma membranes, which is then used by cells for a number of functions including sugar and amino acid transport, diuresis and nerve cell signaling. The Na+/K+ ATPase pump is a trimer of a 100-kilodalton (kDa) alpha ($\alpha$) subunit, a 40-kDa beta ($\beta$) subunit, and a 6-kDa gamma ($\gamma$) subunit. Most insects express three isotypes of the $\beta$ subunit, each being expressed in a tissue and cell-type dependent manner. The $\alpha$ subunit has 8 transmembrane domains whereas the $\beta$ and $\gamma$ subunits have just one. The $\alpha$ subunit mediates ATPase and ion transporting activities and together with the $\gamma$ subunit comprises the site for cardiac glycoside (ouabain) binding.

The $\beta$ subunit is required for detectable pump activity, and is thought to have roles in stability, localization, and determining cation specificity. As such, a flea NKAB protein of the present invention represents a novel target for anti-flea vaccines and chemotherapeutic drugs.

Ligand-gated ion channel family proteins have been shown to transmit neural signals in response to binding neurotransmitters such as GABA, glycine, and glutamate. GABA and glycine receptors transmit inhibitory signals whereas glutamate receptors transmit excitatory signals. This family of proteins is the target for many drugs affecting neural signaling, and also for several families of insecticides including cyclodienes, pyrethroids, and phenyl pyrazoles. Northern blot analysis indicates that the mRNA corresponding to a LGIC nucleic acid molecule of the present invention is only expressed in HMT tissue, which suggests a role in the regulation or mediation of diuresis. Without being bound by theory, assuming protein expression correlates with the mRNA expression, flea LGIC may represent the first of this family of receptors shown to be exclusively expressed in renal tissue. Sequence analysis shows that a flea LGIC protein is distinct from other subfamilies of ligand-gated ion channels, and thus may represent a new subfamily. As such, a flea LGIC protein of the present invention represents a novel target for anti-flea vaccines and chemotherapeutic drugs.

The function of ANON/23DA protein largely unknown. The ANON/23DA gene is reported to be linked to the MAD gene in *Drosophila*, though it is not known if ANON/23DA and MAD are functionally related. ANON/23DA may also have functional similarity to human probable membrane receptor protein pHPS 1-2, which is similar to rhodopsin/beta-adrenergic receptor which plays an important role in kidney function. As such, a flea ANON/23DA protein of the present invention represents a novel target for anti-flea vaccines and chemotherapeutic drugs.

*Drosophila* malvolio shows high sequence homology to mammalian natural resistance associated proteins (NRAMPs) and to yeast Smf1, which are proteins that transport divalent cations, specifically Mn++, Zn++, and Fe++. NRAMPs have also been shown be similar to ATPase transporters and use ATP as an energy source. There are two types of NRAMP proteins, NRAMP1 and NRAMP2. NRAMP1 is expressed exclusively on macrophages and is responsible for preventing intracellular replication of microbes. NRAMP2 is expressed in several cell and tissue types, including mouse intestinal epithelia. Flea malvolio proteins of the present invention appear to be most similar to NRAMP1. As such, a flea malvolio protein of the present invention represents a novel target for anti-flea vaccines and chemotherapeutic drugs.

The function of OS-D proteins is largely unknown. An OS-D nucleic acid molecule isolated from a *Drosophila melanogaster* antenna cDNA library encodes a protein that shares features common to vertebrate odorant-binding proteins, but has a primary structure unlike odorant-binding proteins. The encoded protein is also homologous to a family of soluble chemosensory proteins from the chemosensory organ of the desert locust, *Schistocerca gregaria*. As such, a flea OS-D protein of the present invention represents a novel target for anti-flea vaccines and chemotherapeutic drugs.

NMDA receptors are a subtype of glutamate-gated ion channels. All glutamate-gated ion channels transmit Na+ and K+ when stimulated, resulting in a depolarization of the membrane potential. NMDA receptors also transport Ca++ into cells upon stimulation, which distinguishes NMDA receptors from the other glutamate-gated ion channels. NMDA receptors play an important role in glutamate excitotoxicity, which has been linked to a number of neurodegenerative disorders such as focal cerebral ischemia (stroke), Parkinson's disease, Huntington's chorea, Alzheimer's disease, schizophrenia and epilepsy. It is thought that the Ca++ influx in open NMDA channels is the mediator for these diseases, since the increase in intracellular Ca++ concentration leads to the induction of metabolic changes in the cell, including the activation of Ca++ dependent proteases and production of free-oxygen radicals. As such, a flea NMDA protein of the present invention represents a novel target for anti-flea vaccines and chemotherapeutic drugs.

CLBP proteins of the present invention appear to fall into the family of PBP/GOBP proteins (pheromone binding protein/general odorant binding protein) based on sequence homology with members of this family (30% identity with PBPRP-2, pheromone binding protein related protein #2 of *Drosophila melanogaster*, and approximately the same identity with CSRLLBP, chemical sense related lipophilic ligand binding protein of *Phormia regina*). Without being bound by theory, it is believed that these proteins are involved in the perception of odors or pheromones, such as the ability to sense the presence of a host or mate. As such, a flea CLBP protein of the present invention represents a novel target for anti-flea vaccines and chemotherapeutic drugs.

Peritrophins, including flea PL2, PL3 and PL4 proteins of the present invention, are a family of putative chitin-binding proteins that comprise a structural component of the peritrophic matrix, an acellular membrane composed of proteins and sugars, most commonly chitin which forms a barrier between the contents of an ingested meal and the gut epithelia. Peritrophin-like proteins have also been shown to be present in the trachea of *Drosophila* embryos, indicating that such proteins may have additional roles outside the midgut. The function of the peritrophin-like proteins in adult fleas is not clear, since adult fleas do not produce a peritrophic matrix in the gut. Peritrophins have been investigated as targets for immunological control of hematophagous insects including the sheep blowfly, *Lucilia cuprina*. It has been shown in this insect that ingestion of antibodies against peritrophins inhibits the growth of larvae and can result in increased larval mortality. It has also been shown that the ingestion of antibodies against peritrophins reduces the permeability of the peritrophic matrix in *L. cuprina* larvae. This in turn may inhibit the movement of digested food across the peritrophic matrix to the gut epithelium, resulting in starvation. As such, a flea peritrophin of the present invention represents a novel target for anti-flea vaccines and chemotherapeutic drugs.

In general, voltage-gated chloride channels (VGCC) maintain resting epithelial and neural membrane potentials and prevent hyperexcitability (sustained contraction) in muscle cells. In *Drosophila* Malpighian tubules, the diuretic hormone leukokinin has been shown to stimulate voltage-gated chloride channels in the stellate cells by increasing intracellular calcium levels. The flea VGCC protein sequence of the present invention contains an EF-hand calcium binding motif, indicating potential regulation by calcium ions, and thus a possible link to leukokinins and diuresis. Chloride channels are critical for diuresis since chloride is the primary anion driving diuresis and is required to help neutralize the sodium and potassium cations that are secreted into the lumen in response to diuretic peptide. The mRNA for the VGCC of the present invention has been shown to be HMT-specific in adult fleas, indicating a potential role in diuresis. As such, a flea VGCC of the present invention represents a novel target for anti-flea vaccines and chemotherapeutic drugs.

The CLIC family of chloride channels are voltage-gated chloride channels that are expressed on a variety of vesicles and are thought to act in concert with the V-ATPase pump to regulate the pH of the vesicle interior. Members of the CLIC family have also been shown to be expressed on the plasma membrane, again, in association with the V-ATPase pump. In humans, a homologous protein has been shown to be expressed on the plasma membrane in epithelial tissues, suggesting a possible role in transepithelial chloride transport and in cows, an antibody against a homologous channel has been shown to inhibit all chloride conductance in kidney microsomes. If the CLIC gene product is indeed involved in transepithelial chloride transport in HMT tissues, it likely plays a critical role in mediating diuresis. As such, a flea CLIC of the present invention represents a novel target for anti-flea vaccines and chemotherapeutic drugs.

The NAH exchanger uses the proton gradient in the lumen of the Malpighian tubule to power the transport of sodium ions across the apical membrane into the lumen. The transport of sodium ions across the Malpighian tubule epithelia is induced by diuretic peptide and is a critical step in the induction of diuresis. The Northern blot analysis described herein indicates that NAH mRNA is upregulated within 15 minutes of feeding in adults, which is consistent with a molecule having a role in diuresis. In many insects, sodium has been shown to be the principle ion driving diuresis. The NAH exchanger has been shown to be located on the apical membrane in the Malpighian tubules, but may also be located in the hindgut and rectum. If located in the hindgut and rectum, it could be accessible to antibody attack on either the basolateral or apical membranes. As such, a flea NAH of the present invention represents a novel target for anti-flea vaccines and chemotherapeutic drugs.

SVP proteins have structural and sequence conservation with a bacterial family of proton co-transporters, with the mammalian proton/glucose transporter, and with organic ion transporters. SVP has 12 putative transmembrane regions that arise from an internal duplication. In mammals, it is located on neural and endocrine vesicles and is thought to function in the uptake of neurotransmitters into vesicles utilizing the proton gradient. Neurotransmitters in turn regulate the activity the ion channels on these membranes. In the Malpighian tubules, the activity of the ion channels determines the rate of diuresis, or fluid secretion from the hemolymph into the lumen. Thus, inhibiting the transport of neurotransmitters in the HMT tissues may have significant effects on the functions of these tissues. As such, a flea SVP of the present invention represents a novel target for anti-flea vaccines and chemotherapeutic drugs.

The function of flea AUP proteins is largely unknown. *C. felis* AUP shares some homology to *Drosophila melanogaster* anoxia-regulated gene product fau. The *Drosophila melanogaster* fau gene has no homology to previously described database entries, but localizes to laminal and cortical neurons of the *Drosophila* CNS by in situ hybridization, and plays and important role in response to O2 deprivation as measured by impaired recovery time of transgenic flies over-expressing fau to anoxia. As such, a flea AUP of the present invention represents a novel target for anti-flea vaccines and chemotherapeutic drugs.

A flea 7B2 protein has some BLAST homology to the neuroendocrine protein 7B2 from various organisms, including *Drosophila, C. elegans*, the pond snail *Lymnaea stagnalis*, and humans. 7B2 has been implicated in activation of prohormone convertase 2 (PC2) an important neuroendocrine precursor processing endoprotease. Additionally, 7B2 was found to be critical in islet hormone processing in mice using null mutants which displayed hypoglycemia, hyperproinsulinemia and hypoglucagonemia. As such, a flea 7B2 of the present invention represents a novel target for anti-flea vaccines and chemotherapeutic drugs.

Flea allantoinase nucleic acid molecules of known length isolated from C. felis are denoted "nCfALN$_\#$", for example nCfALN$_{2057}$, wherein "#" refers to the number of nucleotides in that molecule, and allantoinase proteins of known length are denoted "PCfALN$_\#$" (for example PCfALN$_{384}$) wherein "#" refers to the number of amino acid residues in that molecule. Similarly, C. felis CBP nucleic acid molecules and proteins of known length are denoted "nCfCBP$_\#$" and "PCfCBP$_\#$", respectively; C. felis NKAB nucleic acid molecules and proteins of known length are denoted "nCfNKAB#" and "PCfNKAB$_\#$", respectively; C. felis LGIC nucleic acid molecules and proteins of known length are denoted "nCfLGIC$_\#$" and "PCfLGIC$_\#$", respectively; C. felis ANON nucleic acid molecules and proteins of known length are denoted "nCfANON$_\#$" and "PCfANON$_\#$", respectively; C. felis MALV nucleic acid molecules and proteins of known length are denoted "nCfMALV$_\#$" and "PCfMALV$_\#$" respectively; C. felis OS-D nucleic acid molecules and proteins of known length are denoted "nCfOSD$_\#$" and "PCfOSD$_\#$" respectively; C. felis NMDA nucleic acid molecules and proteins of known length are denoted "nCfNMDA$_\#$" and "PCFNMDA$_\#$" respectively; C. felis CLBP nucleic acid molecules and proteins of known length are denoted "nCfCLBP$_\#$" and "PCfCLBP$_\#$" respectively, C. felis NAH nucleic acid molecules and proteins of known length are denoted "nCfNAH$_\#$" and "PCfNAH$_\#$" respectively, C. felis CLIC nucleic acid molecules and proteins of known length are denoted "nCfCLIC$_\#$" and "PCfCLIC$_\#$" respectively, C. felis PL2 nucleic acid molecules and proteins of known length are denoted "nCfPL2$_\#$" and "PCfPL2$_\#$" respectively, C. felis PL3 nucleic acid molecules and proteins of known length are denoted "nCfPL3$_\#$" and "PCfPL3$_\#$" respectively, C. felis PL4 nucleic acid molecules and proteins of known length are denoted "nCfPL4$_\#$" and "PCfPL4$_\#$" respectively, C. felis SVP nucleic acid molecules and proteins of known length are denoted "nCfSVP$_\#$" and "PCFSVP$_\#$" respectively, C. felis VGCC nucleic acid molecules and proteins of known length are denoted "nCfVGCC$_\#$" and "PCFVGCC$_\#$" respectively, C. felis AUP nucleic acid molecules and proteins of known length are denoted "nCAUPf$_\#$" and "PCfAUP$_\#$" respectively, and C. felis 7B2 nucleic acid molecules and proteins of known length are denoted "nCf7B2$_\#$" and "PCf7B2$_\#$" respectively.

The present invention also provides for HMT and HNC DNA molecules that are specific tags for messenger RNA molecules derived from HMT and HNC tissues. Such DNA molecules can correspond to an entire or partial sequence of a messenger RNA, and therefore, a DNA molecule corresponding to such a messenger RNA molecule (i.e. a cDNA molecule), can encode a full-length or partial-length protein. A nucleic acid molecule encoding a partial-length protein can be used directly as a probe or indirectly to generate primers to identify and/or isolate a cDNA nucleic acid molecule encoding a corresponding, or structurally related, full-length protein. Such a partial cDNA nucleic acid molecule can also be used in a similar manner to identify a genomic nucleic acid molecule, such as a nucleic acid molecule that contains the complete gene including regulatory regions, exons and introns. Methods for using partial HMT and HNC cDNA molecules and sequences to isolate full-length transcripts and corresponding cDNA molecules are described in the examples herein below.

The proteins and nucleic acid molecules of the present invention can be obtained from their natural source, or can be produced using, for example, recombinant nucleic acid technology or chemical synthesis. Also included in the present invention is the use of these proteins and nucleic acid molecules as well as antibodies and inhibitory compounds thereto as therapeutic compositions to protect animals from flea infestation as well as in other applications, such as those disclosed below.

Flea HMT and HNC proteins and nucleic acid molecules of the present invention have utility because they represent novel targets for anti-arthropod vaccines and chemotherapeutic drugs. The products and processes of the present invention are advantageous because they enable the inhibition of arthropod development, metamorphosis, feeding, digestion and/or reproduction processes that involve HMT and/or HNC proteins.

The head and nerve cord of the flea, including antennae, brain, corpora cardiacum, corpora allata, and subesophageal and abdominal ganglion tissues are of interest as such tissues are highly enriched for transcripts that encode neuronal and endocrine targets, as well as targets involved in chemosensory and mechanosensory reception. By sequencing cDNA fragments from a library enriched in flea head and nerve cord nucleic acid sequences (referred to herein as HNC nucleic acid sequences), genes, and their respective full-length coding regions, integrally involved with flea neuronal and endocrine function are identified. Once identified, these genes can be further characterized and specific interference strategies are designed. As such, flea HNC proteins and nucleic acid molecules of the present invention have utility because they represent novel targets for anti-arthropod vaccines and chemotherapeutic drugs.

Blood-feeding insects such as fleas ingest large quantities of blood relative to their body weight and, as such, are adapted to reduce the volume of the ingested blood meal through the rapid elimination of water. In addition, the concentrations of sodium, potassium, and chloride ions in the blood meal are greater than in the hemolymph of fleas, necessitating the excretion of excessive amounts of these ions. The active transport of these ions from the hemolymph into the lumens of the Malpighian tubules and the hindgut drives the passive transport of water and other hemolymph contents into these organs as well. While passing through these organs, waste products from the hemolymph are excreted and needed nutrients, water, and salts are reabsorbed. As such, interfering with these essential processes is an important strategy for developing a product for controlling flea populations. By sequencing cDNA fragments from a library enriched in hindgut and Malpighian tubule nucleic acid sequences (referred to herein as HMT nucleic acid sequences), genes integrally involved with these processes, and their respective full-length coding regions, are identified. Once identified, these genes are further characterized and specific interference strategies can be designed. As such, flea HMT proteins and nucleic acid molecules of the present invention have utility because they represent novel targets for anti-arthropod vaccines and chemotherapeutic drugs.

One embodiment of the present invention is an isolated protein that includes a flea HMT and/or HNC protein. It is to be noted that the term "a" or "an" entity refers to one or more of that entity; for example, a protein, a nucleic acid molecule, an antibody and a therapeutic composition refers to "one or more" or "at least one" protein, nucleic acid molecule, antibody and therapeutic composition respectively. As such, the terms "a" (or "an"), "one or more" and "at least one" can be used interchangeably herein. It is also to be noted that the terms "comprising", "including", and "having" can be used interchangeably. According to the present invention, an isolated, or biologically pure, protein, is a protein that has been removed from its natural milieu. As such, "isolated" and "biologically pure" do not necessarily reflect the extent to which the protein has been purified. An isolated protein of the present invention can be obtained from its natural source, can be produced using recombinant DNA technology, or can be produced by chemical synthesis.

As used herein, isolated flea HMT and/or HNC proteins of the present invention can be full-length proteins or any homologue of such proteins. An isolated protein of the present invention, including a homologue, can be identified in a straight-forward manner by the protein's ability to elicit an immune response against a flea HMT and/or HNC protein or by the protein's HMT and/or HNC activity. Examples of flea HMT and HNC homologue proteins include flea HMT and HNC proteins in which amino acids have been deleted (e.g., a truncated version of the protein, such as a peptide), inserted, inverted, substituted and/or derivatized (e.g., by glycosylation, phosphorylation, acetylation, myristoylation, prenylation, palmitoylation, amidation and/or addition of glycerophosphatidyl inositol) such that the homologue includes at least one epitope capable of eliciting an immune response against a flea HMT or HNC protein, and/or of binding to an antibody directed against a flea HMT or HNC protein. That is, when the homologue is administered to an animal as an immunogen, using techniques known to those skilled in the art, the animal will produce an immune response against at least one epitope of a natural flea HMT or HNC protein. The ability of a protein to effect an immune response can be measured using techniques known to those skilled in the art. As used herein, the term "epitope" refers to the smallest portion of a protein or other antigen capable of selectively binding to the antigen binding site of an antibody or a T cell receptor. It is well accepted by those skilled in the art that the minimal size of a protein epitope is about four to six amino acids. As is appreciated by those skilled in the art, an epitope can include amino acids that naturally are contiguous to each other as well as amino acids that, due to the tertiary structure of the natural protein, are in sufficiently close proximity to form an epitope. According to the present invention, an epitope includes a portion of a protein comprising at least about 4 amino acids, at least about 5 amino acids, at least about 6 amino acids, at least about 10 amino acids, at least about 15 amino acids, at least about 20 amino acids, at least about 25 amino acids, at least about 30 amino acids, at least about 35 amino acids, at least about 40 amino acids or at least about 50 amino acids in length.

In one embodiment of the present invention a flea homologue protein has HMT or HNC activity, i.e. the homologue exhibits an activity similar to its natural counterpart. Examples of such activities are disclosed herein; e.g., all. Methods to detect and measure such activities are known to those skilled in the art. Examples of such activities are disclosed herein; e.g. allantoinase, chitin-binding protein, sodium/potassium ATPase, ligand-gated chloride channel, ANON/23DA, malvolio, odorant binding protein-like protein, N-methyl-D-aspartate receptor associated protein, chemical sense related lipophilic ligand binding protein, Sodium/Hydrogen Transporter-like protein, a Chloride Intracellular Channel-like protein, aPeritrophin-like protein, aPeritrophin-like protein, aPeritrophin-like protein, a synaptic vesicle 2B-like protein, a voltage-gated Chloride-like protein, an anoxia upregulated protein-like protein, and a neuroendocrine specific 7B2-like protein.

Flea HMT and/or HNC homologue proteins can be the result of natural allelic variation or natural mutation. Flea HMT and/or HNC protein homologues of the present invention can also be produced using techniques known in the art including, but not limited to, direct modifications to the protein or modifications to the gene encoding the protein using, for example, classic or recombinant DNA techniques to effect random or targeted mutagenesis.

Flea HMT and HNC proteins of the present invention are encoded by flea HMT and HNC nucleic acid molecules, respectively. As used herein, flea HMT and HNC nucleic acid molecules include nucleic acid sequences related to natural flea HMT and HNC genes, and, preferably, to *Ctenocephalides felis* HMT and HNC genes. As used herein, flea HMT and HNC genes include all regions such as regulatory regions that control production of flea HMT and HNC proteins encoded by such genes (such as, but not limited to, transcription, translation or post-translation control regions) as well as the coding region itself, and any introns or non-translated coding regions. As used herein, a nucleic acid molecule that "includes" or "comprises" a sequence may include that sequence in one contiguous array, or may include the sequence as fragmented exons such as is often found for a flea gene. As used herein, the term "coding region" refers to a continuous linear array of nucleotides that translates into a protein. A full-length coding region is that coding region that is translated into a full-length, i.e., a complete protein as would be initially translated in its natural millieu, prior to any post-translational modifications.

One embodiment of the present invention is a *C. felis* ALN gene that includes the nucleic acid sequence SEQ ID NO:1 and/or SEQ ID NO:4, a *C. felis* CBP gene that includes the nucleic acid sequence SEQ ID NO:7 and/or SEQ ID NO:10, a *C. felis* NKAB gene that includes the nucleic acid sequence SEQ ID NO:13 and/or SEQ ID NO:16, a *C. felis* LGIC gene that includes the nucleic acid sequence SEQ ID NO:19, SEQ ID NO:22, SEQ ID NO:1861, and/or SEQ ID NO:1864, a *C. felis* ANON gene that includes the nucleic acid sequence SEQ ID NO:25 and/or SEQ ID NO:28, a *C. felis* MALV gene that includes the nucleic acid sequence SEQ ID NO:31 and/or SEQ ID NO:34, a *C felis* OS-D gene that includes the nucleic acid sequence SEQ ID NO:37 and/or SEQ ID NO:40, a *C. felis* NMDA gene that includes the nucleic acid sequence SEQ ID NO:43 and/or SEQ ID NO:46, a *C. felis* CLBP gene that includes the nucleic acid sequence SEQ ID NO:153, SEQ ID NO:156, SEQ ID NO:159, SEQ ID NO:162, SEQ ID NO:165, and/or SEQ ID NO:168, a *C. felis* NAH gene that includes the nucleic acid sequence SEQ ID NO:1867 and/or SEQ ID NO:1870, a *C. felis* CLIC gene that includes the nucleic acid sequence SEQ ID NO:1872 and/or SEQ ID NO:1875, a *C. felis* PL2 gene that includes the nucleic acid sequence SEQ ID NO:1877, SEQ ID NO:1878, SEQ ID NO:1880, SEQ ID NO:1882 and/or SEQ ID NO:1885, a *C. felis* PL3 gene that includes the nucleic acid sequence SEQ ID NO:1887 and/or SEQ ID NO:1890, a *C. felis* PL4 gene that includes the nucleic acid sequence SEQ ID NO:1896 and/or SEQ ID NO:1899, a *C. felis* SVP gene that includes the nucleic acid sequence SEQ ID NO:1901 and/or SEQ ID NO:1904, a *C. felis* VGCC gene that includes the nucleic acid sequence SEQ ID NO:1914 and/or SEQ ID NO:1917, a *C. felis* AUP gene that includes the nucleic acid sequence SEQ ID NO:1919 and/or SEQ ID NO:1922, a *C. felis* 7B2 gene that includes the nucleic acid sequence SEQ ID NO:1924 and/or SEQ ID NO:1927, a *C. felis* gene that includes a nucleic acid sequence of Table I, Table II, Table III and/or Table IV; as well as the complements of any of these nucleic acid sequences. These nucleic acid sequences are further described herein. For example, nucleic acid sequence SEQ ID NO:1 represents the deduced sequence of the coding strand of a *C. felis* cDNA denoted herein as *C. felis* ALN nucleic acid molecule $nCfALN_{2057}$, the production of which is disclosed in the Examples. Nucleic acid molecule SEQ ID NO:1 comprises an apparently full-length coding region. The complement of SEQ ID NO:1 (represented herein by SEQ ID NO:3) refers to the nucleic acid sequence of the strand fully complementary to the strand having SEQ ID NO:1, which can easily be determined by those skilled in the art. Likewise, a nucleic acid sequence complement of any nucleic acid sequence of the present invention refers to the nucleic acid sequence of the nucleic acid strand that is fully complementary to (i.e., can form a complete double helix with) the strand for which the sequence is cited. For example, the complements of SEQ ID NOs: 4, 7, 10, 13, 16, 19, 22, 25, 28, 31, 34, 37, 40, 43, 46, 153, 156, 159, 162, 165, and 168 are SEQ ID NOs: 6, 9, 12, 15, 18, 21, 24, 27, 30, 33, 36, 39, 42, 45, 48, 155, 158, 161, 164, 167, and 170, respectively. It should be noted that since nucleic acid sequencing technology is not entirely error-free, SEQ ID NO:1 (as well as other nucleic acid and protein sequences presented herein) represents an apparent nucleic acid sequence of the nucleic acid molecule encoding an ALN protein of the present invention.

Translation of SEQ ID NO:1, the coding strand of $nCfALN_{2057}$, as well as translation of SEQ ID NO:4, the coding strand of $nCfALN_{1152}$, which represents the coding region of SEQ ID NO:1, each yields a protein of about 384 amino acids, denoted herein as $PCfALN_{384}$, the amino acid sequence of which is presented in SEQ ID NO:2, assuming a first in-frame codon extending from nucleotide 1 to nucleotide 3 of SEQ ID NO:4.

Translation of SEQ ID NO:7, the coding strand of $nCfCBP_{1128}$, as well as translation of SEQ ID NO:10, the coding strand of $nCfCBP_{1128}$, which represents the coding region of SEQ ID NO:7, each yields a protein of about 272 amino acids, denoted herein as $PCfCBP_{272}$, the amino acid sequence of which is presented in SEQ ID NO:8, assuming a first in-frame codon extending from nucleotide 1 to nucleotide 3 of SEQ ID NO:10.

Translation of SEQ ID NO:13, the coding strand of $nCfNKAB_{1714}$, as well as translation of SEQ ID NO:16, the coding strand of $nCfNKAB_{978}$, which represents the coding region of SEQ ID NO:13, each yields a protein of about 326 amino acids, denoted herein as $PCfNKAB_{326}$, the amino acid sequence of which is presented in SEQ ID NO:14, assuming a first in-frame codon extending from nucleotide 1 to nucleotide 3 of SEQ ID NO:16.

Translation of SEQ ID NO:19, the coding strand of $nCfLGIC_{2240}$, as well as translation of SEQ ID NO:22, the coding strand of $nCfLGIC_{1707}$, which represents the coding region of SEQ ID NO:19, each yields a protein of about 569 amino acids, denoted herein as $PCfLGIC_{569}$, the amino acid sequence of which is presented in SEQ ID NO:20, assuming a first in-frame codon extending from nucleotide 1 to nucleotide 3 of SEQ ID NO:22.

Translation of SEQ ID NO:25, the coding strand of $nCfANON_{1429}$, as well as translation of SEQ ID NO:28, the coding strand of $nCfANON_{1194}$, which represents the coding region of SEQ ID NO:25, each yields a protein of about 398 amino acids, denoted herein as $PCfANON_{398}$, the amino acid sequence of which is presented in SEQ ID NO:26, assuming a first in-frame codon extending from nucleotide 1 to nucleotide 3 of SEQ ID. NO:28.

Translation of SEQ ID NO:31, the coding strand of $nCfMALV_{765}$, as well as translation of SEQ ID NO:34, the coding strand of $nCfMALV_{762}$, which represents the coding region of SEQ ID NO:31, each yields a protein of about 327 amino acids, denoted herein as $PCfMALV_{254}$, the amino acid sequence of which is presented in SEQ ID NO:32, assuming a first in-frame codon extending from nucleotide 1 to nucleotide 3 of SEQ ID NO:34.

Translation of SEQ ID NO:37, the coding strand of $nCfOSD_{604}$, as well as translation of SEQ ID NO:40, the coding strand of $nCfOSD_{405}$, which represents the coding region of SEQ ID NO:37, each yields a protein of about 135 amino acids, denoted herein as $PCfOSD_{135}$, the amino acid sequence of which is presented in SEQ ID NO:38, assuming a first in-frame codon extending from nucleotide 1 to nucleotide 3 of SEQ ID NO:40.

Translation of SEQ ID NO:43, the coding strand of $NMDA_{1227}$, as well as translation of SEQ ID NO:46, the coding strand of $nCfNMDA_{738}$, which represents the coding region of SEQ ID NO:43, each yields a protein of about 246 amino acids, denoted herein as $PCfNMDA_{246}$, the amino acid sequence of which is presented in SEQ ID NO:44, assuming a first in-frame codon extending from nucleotide 1 to nucleotide 3 of SEQ ID NO:46.

Translation of SEQ ID NO:153, the coding strand of $nCfCLBP1A_{633}$, as well as translation of SEQ ID NO:156, the coding strand of $nCfCLBP1A_{441}$, which represents the coding region of SEQ ID NO:153, each yields a protein of about 147 amino acids, denoted herein as $PCfCLBP_{147}$, the amino acid sequence of which is presented in SEQ ID NO:154, assuming a first in-frame codon extending from nucleotide 1 to nucleotide 3 of SEQ ID NO:156.

Translation of SEQ ID NO:162, the coding strand of $nCfCLBP2A_{631}$, as well as translation of SEQ ID NO:165, the coding strand of $nCfCLBP2A_{441}$, which represents the coding region of SEQ ID NO:162, each yields a protein of about 147 amino acids, denoted herein as $PCfCLBP2A_{147}$, the amino acid sequence of which is presented in SEQ ID NO:163, assuming a first in-frame codon extending from nucleotide 1 to nucleotide 3 of SEQ ID NO:165.

Translation of SEQ ID NO:1861, the coding strand of $nCfLGIC_{2739}$, as well as translation of SEQ ID NO:1864, the coding strand of $nCfLGIC_{2016}$, which represents the coding region of SEQ ID NO:1861, each yields a protein of about 672 amino acids, denoted herein as $PCfLGIC_{672}$, the amino acid sequence of which is presented in SEQ ID NO:1862, assuming a first in-frame codon extending from nucleotide 1 to nucleotide 3 of SEQ ID NO:1864.

Translation of SEQ ID NO:1867, the coding strand of $nCfNAH_{2080}$, as well as translation of SEQ ID NO:1870, the coding strand of $nCfNAH_{1824}$, which represents the coding region of SEQ ID NO:1867, each yields a protein of about 608 amino acids, denoted herein as $PCfNAH_{608}$, the amino acid sequence of which is presented in SEQ ID NO:1868, assuming a first in-frame codon extending from nucleotide 1 to nucleotide 3 of SEQ ID NO:1870.

Translation of SEQ ID NO:1872, the coding strand of $nCfCLIC_{2283}$, as well as translation of SEQ ID NO:1875, the coding strand of $nCfCLIC_{786}$, which represents the coding region of SEQ ID NO:1872, each yields a protein of about 262 amino acids, denoted herein as $PCfCLIC_{262}$, the amino acid sequence of which is presented in SEQ ID NO:1873, assuming a first in-frame codon extending from nucleotide 1 to nucleotide 3 of SEQ ID NO:1875.

Translation of SEQ ID NO:1882, the coding strand of $nCfPL2_{1477}$ as well as translation of SEQ ID NO:1885, the coding strand of $nCfPL2_{1359}$, which represents the coding region of SEQ ID NO:1882, each yields a protein of about 453 amino acids, denoted herein as PCfPL2$_{453}$, the amino acid sequence of which is presented in SEQ ID NO:1883, assuming a first in-frame codon extending from nucleotide 1 to nucleotide 3 of SEQ ID NO:1885.

Translation of SEQ ID NO:1887, the coding strand of nCfPL3$_{406}$, as well as translation of SEQ ID NO:1890, the coding strand of nCfPL3$_{243}$, which represents the coding region of SEQ ID NO:1887, each yields a protein of about 81 amino acids, denoted herein as PCfPL3$_{81}$, the amino acid sequence of which is presented in SEQ ID NO:1888, assuming a first in-frame codon extending from nucleotide 1 to nucleotide 3 of SEQ ID NO:1890.

Translation of SEQ ID NO:1896, the coding strand of nCfPL4$_{1062}$, as well as translation of SEQ ID NO:1899, the coding strand of nCfPL4$_{855}$, which represents the coding region of SEQ ID NO:1896, each yields a protein of about 285 amino acids, denoted herein as PCfPL4$_{285}$, the amino acid sequence of which is presented in SEQ ID NO:1897, assuming a first in-frame codon extending from nucleotide 1 to nucleotide 3 of SEQ ID NO:1899.

Translation of SEQ ID NO:1901, the coding strand of nCfSVP$_{1875}$, as well as translation of SEQ ID NO:1904, the coding strand of nCfSVP$_{1590}$, which represents the coding region of SEQ ID NO:1901, each yields a protein of about 530 amino acids, denoted herein as PCfSVP$_{530}$, the amino acid sequence of which is presented in SEQ ID NO:1902, assuming a first in-frame codon extending from nucleotide 1 to nucleotide 3 of SEQ ID NO:1904.

Translation of SEQ ID NO:1914, the coding strand of nCfVGCC$_{3126}$, as well as translation of SEQ ID NO:1917, the coding strand of nCfVGCC$_{2553}$, which represents the coding region of SEQ ID NO:1914, each yields a protein of about 851 amino acids, denoted herein as PCfVGCC$_{851}$, the amino acid sequence of which is presented in SEQ ID NO:1915, assuming a first in-frame codon extending from nucleotide 1 to nucleotide 3 of SEQ ID NO:1917.

Translation of SEQ ID NO:1919, the coding strand of nCfAUP$_{1181}$, as well as translation of SEQ ID NO:1922, the coding strand of nCfAUP$_{306}$, which represents the coding region of SEQ ID NO:1919, each yields a protein of about 102 amino acids, denoted herein as PCfAUP$_{102}$, the amino acid sequence of which is presented in SEQ ID NO:1920, assuming a first in-frame codon extending from nucleotide 1 to nucleotide 3 of SEQ ID NO:1922.

Translation of SEQ ID NO:1924, the coding strand of nCf7B2161, as well as translation of SEQ ID NO:1927, the coding strand of nCf7B2$_{801}$, which represents the coding region of SEQ ID NO:1924, each yields a protein of about 267 amino acids, denoted herein as PCf7B2$_{267}$, the amino acid sequence of which is presented in SEQ ID NO:1925, assuming a first in-frame codon extending from nucleotide 1 to nucleotide 3 of SEQ ID NO:1927.

Table I represents a variety of flea HNC nucleic acid molecules of the present invention. Also cited in Table I are nucleic acid molecules from other organisms which share the closest sequence identity with the cited HNC sequences of the present invention, as determined by submitting each HNC sequence for a search through the National Center for Biotechnology Information (NCBI), National Library of Medicine, National Institute of Health, Baltimore, Md., using the BLAST network. This database includes SwisProt+PIR+SPupdate+GenPept+GPUpdate+PDB databases. The search was conducted using the xBLAST function using default parameters.

TABLE I

| SEQ ID NO: | Name | Genbank Homology | Organism |
|---|---|---|---|
| 63 | 2096-46 | ATPase 6 | D. melanogaster |
| 64 | 2098-25 | ATP synthase delta chain | Sus scrofa |
| 65 | 2098-34 | F1-ATPase epsilon-subunit | Ipomoea batatas |
| 66 | 2110-19 | ATP synthase beta subunit | Drosophila pseudoobscura |
| 67 | 2113-15 | ATP synthase delta chain, | Sus scrofa |
| 68 | 2180-31 | ATP synthase alpha subunit precursor | Rattus rattus |
| 69 | 2224-50 | oligomysin sensitivity conferring protein | D. melanogaster |
| 70 | 2116-51 | cysteine dioxygenase | Homo sapiens |
| 71 | 2116-55 | pyrroline-5-carboxylate dehydrogenase (P5CDh) | Homo sapiens |
| 72 | 2124-17 | AMP deaminase | Homo sapiens |
| 73 | 2138-38 | ubiquitin | Mus musculus |
| 74 | 2184-59 | manganese superoxide dismutase | Homo sapiens |
| 75 | 2096-24 | muscle LIM protein 1 | D. melanogaster |
| 76 | 2140-53 | F25H5.1a | C. elegans |
| 77 | 2176-41 | Frazzled | D. melanogaster |
| 78 | 2223-11 | LIMm domain-containing protein | C. elegans |
| 79 | 2223-53 | deleted in split hand/split foot 1 (DSS1) | Homo sapiens |
| 80 | 2225-28 | stranded-at-second | D. melanogaster |
| 81 | 2099-61 | histone H3 | Spisula solidissima |
| 82 | 2114-21 | STE12 | S. cereviciae |
| 83 | 2117-4 | Rad51 homolog | Bombyx mori |
| 84 | 2138-46 | heat shock protein p27 | D. immitis |
| 85 | 2182-37 | heat shock protein 70 | D. immitis |
| 86 | 2211-32 | BTB-II protein domain gene | D. melanogaster |
| 87 | 2223-7 | heat shock protein | D, melanogaster |
| 88 | 2224-17 | heat shock protein 86 | Homo sapiens |
| 89 | 2225-16 | POU domain protein | D. melanogaster |
| 90 | 2225-18 | nucleolin | Xenopus laevis |
| 91 | 2212-85 | thyroid hormone receptor-associated protein complex component TRAP220 | Homo sapiens |
| 92 | 2211-21 | T03D8.3 | C. elegans |
| 93 | 2223-67 | hepatoma derived growth factor (HDGF) | Mus musculus |
| 94 | 2225-61 | tyrosine hydroxylase type 1 (neuronal form) | D. melanogaster |
| 95 | 2097-7 | sarco/endoplasmic reticulum-type Ca-2+-ATPase | D. melanogaster |
| 96 | 2098-27 | calcium-transporting ATPase | D. melanogaster |
| 97 | 2099-19 | calcium channel alpha-1 subunit | Aplysia californica |
| 98 | 2120-5 | P-type voltage-gated calcium channel alpha 1 subunit homolog | Homo sapiens |
| 99 | 2124-2 | sarco/endoplasmic reticulum Ca2+-ATPase (SERCA) | Procambarus clarkii |
| 100 | 2182-43 | sulfonylurea receptor 2b | Mus musculus |
| 101 | 2223-18 | Sodium-Potassium-Chloride cotransporter | D. melanogaster |
| 102 | 2223-63 | sarco/endoplasmic reticulum-type Ca2(+)-ATPase | D. melanogaster |
| 103 | 2224-13 | similar to ABC transporters | C. elegans |
| 104 | 2098-3 | Camguk | D. melanogaster |
| 105 | 2101-9 | UNC-89 | C. elegans |
| 106 | 2132-31 | arginine kinase | Homarus gammarus |
| 107 | 2141-51 | casein kinase-II beta | Oryctolagus cuniculus |
| 108 | 2178-18 | diacylglycerol kinase eta | Cricetinae |
| 109 | 2180-32 | retinoid- and fatty acid-binding glycoprotein | D. melanogaser |
| 110 | 2137-23 | vitellogenin | Aedes aegypti |
| 111 | 2144-14 | nuclear localization signal spot 1 | Mus musculus |
| 112 | 2212-13 | putative n- terminal acetyltransferase | S. cereviciae |
| 113 | 2212-27 | clathrin associated protein AP47 | Drosophila grimshawi |
| 114 | 2223-28 | O1 chloroquine-resistance protein | Plasmodium falciparans |
| 115 | 2224-14 | vitellogenin | Athalia rosae |
| 116 | 2224-15 | antigen NY-CO-3 | Homo sapiens |
| 117 | 2225-24 | carbonic anhydrase | C. elegans |
| 118 | 2225-58 | yk500f6.3 | C. elegans |
| 119 | 2225-76 | unknown | Homo sapiens |

TABLE I-continued

| SEQ ID NO: | Name | Genbank Homology | Organism |
|---|---|---|---|
| 120 | 2224-86 | BmP109 (cerebroside sulfate activator protein family) | Bombyx mori |
| 121 | 2225-23 | intersectin | Homo sapiens |
| 122 | 2170-16 | chemical-sense-related lipophilic-ligand-binding protein | Phormia regina |
| 123 | 2176-2 | olfactory receptor protein 2.4 | Danio rerio |
| 124 | 2212-63 | olfactory receptor | Xenopus laevis |
| 125 | 2224-77 | inner mitochondrial membrane translocase Tim23 | Homo sapiens |
| 126 | 2225-12 | sodium-dependent multi-vitamin transporter | Rattus norvegicus |
| 127 | 2225-42 | ribophorin I | Rattus norvegicus |
| 128 | 2101-59 | phosphate carrier protein | C. elegans |
| 129 | 2132-38 | proteinase inhibitor | Locusta migratoria |
| 130 | 2174-72 | HE4 protein | Homo sapiens |
| 131 | 2211-48 | spermatogenic cell/sperm-associated Tat-binding homologue | Rattus norvegicus |
| 132 | 2110-23 | Gcap1 gene product | Mus musculus |
| 133 | 2116-64 | toll protein | D. melanogaster |
| 134 | 2124-3 | tuberin (TSC2) gene | Homo sapiens |
| 135 | 2178-55 | RAS-like protein | Gallus gallus |
| 136 | 2223-35 | Rho1 gene product | D. melanogaster |
| 137 | 2224-82 | paxillin | Homo sapiens |
| 138 | 2225-44 | adenylyl cyclase-associated protein (CAP) | Homo sapiens |
| 139 | 2225-80 | adenylate kinase | Gallus gallus |
| 140 | 2110-52 | hydroxyproline-rich glycoprotein | Phaseolus vulgaris |
| 141 | 2115-49 | mitogen inducible gene mig-2 | Homo sapiens |
| 142 | 2116-5 | F52H3.5 | C. elegans |
| 143 | 2172-89 | 12D3 antigen | Babesia bovis |
| 144 | 2178-20 | frameshift | P. falciparum |
| 145 | 2178-81 | KIAA0066 | Homo sapeins |
| 146 | 2182-16 | Y57G11C.4 | C. elegans |
| 147 | 2182-53 | C16C10.5 | C. elegans |
| 148 | 2211-8 | Unknown | Homo sapiens |
| 149 | 2211-31 | hopothetical protein | Arabidopsis thaliana |
| 150 | 2223-54 | ORF YNL207w | S. cereviciae |
| 151 | 2224-94 | 14.3 kDa perchloric acid soluble protein | Capra hircus |
| 152 | 2225-36 | EST clone | C. elegans |
| 1719 | 2228-2 | BIGH3 | H. sapiens |
| 1720 | 2228-5 | H protein | H. sapiens |
| 1721 | 2228-8 | ubiquinol-cytochrome c reductase | Schizosaccharomyces pombe |
| 1722 | 2228-11 | similar to mitochondrial ATPase inhibitors | C. elegans |
| 1723 | 2228-16 | Putative enzyme | E. coli |
| 1724 | 2228-18 | Ribosomal protein L7A | Drosophila |
| 1725 | 2228-22 | Troponin-I wings up A | Drosophila |
| 1726 | 2228-25 | tls gene product | E. coli |
| 1727 | 2228-27 | YCR521 gene product | Saccharomyces cerevisiae |
| 1728 | 2228-28 | putative transport system permease protein | E. coli |
| 1729 | 2228-32 | SapA protein | E. coli |
| 1730 | 2228-34 | Putative protein | Arabidopsis thaliana |
| 1731 | 2228-37 | Ada | E. coli |
| 1732 | 2228-39 | Titin | H. sapiens |
| 1733 | 2228-42 | adenylosuccinate synthetase | Mus musculus |
| 1734 | 2228-43 | transfer RNA-Ala synthetase | B. mori |
| 1735 | 2228-44 | C4 zinc finger DNA-binding protein | Drosophila |
| 1736 | 2228-48 | heme A: farnesyltransferase | H. sapiens |
| 1737 | 2228-51 | URF 4L (aa 1-96) | Drosophila |
| 1738 | 2228-53 | DOLICHOL-PHOSPHATE MANNOSYLTRANSFERASE | E. coli |
| 1739 | 2228-58 | troponin-T | Drosophila |
| 1740 | 2228-59 | protein disulfide isomerase | Drosophila |
| 1741 | 2228-63 | orf, hypothetical protein | E. coli |
| 1742 | 2228-66 | ilvI polypeptide | E. coli |
| 1743 | 2228-68 | orf, hypothetical protein | E. coli |
| 1744 | 2228-72 | Respiratory nitrate reductase 1 alpha chain | E. coli |
| 1745 | 2228-77 | homolog of virulence factor | E. coli |
| 1746 | 2228-84 | ORF o164 | E. coli |
| 1747 | 2228-91 | nuclear protein E3-3 orf1 | Raffus norvegicus |
| 1748 | 2245-66 | Troponin C | Drosophila |
| 1749 | 2245-70 | Predicted secreted protein | Plasmodium falciparum |
| 1750 | 2245-72 | Cytochrome C-1 | H. sapiens |
| 1751 | 2245-75 | rpoB | Plasmodium falciparum |
| 1752 | 2245-78 | sarco(endo)plasmic reticulum-type calcium ATPase | Helliothis virescens |
| 1753 | 2246-31 | Ras-related GTP-binding protein | H. sapiens |
| 1754 | 2246-57 | Similar to inositol 1,4,5-triphosphate receptor | C. elegans |
| 1755 | 2246-61 | reverse transcriptase-like protein | Aedes aeqypti |
| 1756 | 2247-13 | polyprotein | Drosophila |
| 1757 | 2247-14 | ORF2 for putative reverse transcriptase | Drosophila |
| 1758 | 2247-42 | Asparaginyl tRNA Synthetase | H. sapiens |
| 1759 | 2247-44 | calcium binding protein | Drosophila |
| 1760 | 2247-58 | similar to Fibronectin type III domain | C. elegans |
| 1761 | 2247-62 | reverse transcriptase | Drosophila |
| 1762 | 2247-65 | gag-like protein | Culex pipiens |
| 1763 | 2247-79 | L-3-phosphoserine phosphatase | H. sapiens |
| 1764 | 2247-80 | esterase E4 | Myzus persicae |
| 1765 | 2247-89 | Similar to aldehyde dehydrogenase | C. elegans |
| 1766 | 2248-76 | O-44 protein | Rattus sp. |
| 1767 | 2248-85 | cDNA isolated for this protein using a monoclonal antibody directed against the p27k prosomal protein | H. sapiens |
| 1768 | 2249-3 | Projectin | Drosophila |
| 1769 | 2249-5 | ORF_ID: o312#14 | E. coli |
| 1770 | 2249-9 | Heat shock protein 60 | Culicoides variipennis |
| 1771 | 2249-11 | enigma protein | H. sapiens |
| 1772 | 2249-12 | alpha,alpha-trehalose glucohydrolase | Oryctolagus cuniculus |
| 1773 | 2249-13 | small GTP binding protein | Drosophila |
| 1774 | 2249-14 | Spermidine/putrescine transport system permease | E. coli |
| 1775 | 2249-19 | nueroendocrine-specific protein C | H. sapiens |
| 1776 | 2249-21 | a-agglutinin core subunit | Saccharomyces cerevisiae |
| 1777 | 2249-24 | KIAA0337 | H. sapiens |
| 1778 | 2249-34 | su(wa) protein | Drosophila |
| 1779 | 2249-42 | regulator of kdp operon | E. coli |
| 1780 | 2249-59 | No definition line found | C. elegans |
| 1781 | 2249-60 | proline oxidase | Drosophila |
| 1782 | 2249-62 | Formate acetyltransferase | E. coli |
| 1783 | 2249-70 | similar to HECT-domain | C. elegans |
| 1784 | 2249-75 | PHOSPHORIBOSYLFORMYL-GLYCINAMIDINE CYCLO-LIGASE | E. coli |
| 1785 | 2249-77 | Hypothetical 38.5 kd protein in agal-mtr intergenic region precursor | E. coli |
| 1786 | 2249-85 | D4L | Variola virus |
| 1787 | 2249-87 | similar to isocitrate dehydrogenase | C. elegans |
| 1788 | 2250-6 | Fii (head-tail joining; 117) | Bacteriophage Lambda |
| 1789 | 2250-7 | possible NAGC-like transcriptional regulator | E. coli |
| 1790 | 2250-10 | cysteine string protein | Bos taurus |
| 1791 | 2250-13 | Tol B protein | E. coli |
| 1792 | 2250-14 | 6-phosphogluconate dehydratase | E. coli |
| 1793 | 2250-15 | 6-phosphogluconate dehydratase | E. coli |
| 1794 | 2250-22 | PSST subunit of the NADH: ubiquinone oxidoreductase | Bos taurus |
| 1795 | 2250-30 | sol i 3 antigen | Solenopsis invicta |
| 1796 | 2250-36 | predicted using Genefinder; similar to tRNA synthetases class I (E and Q | C. elegans |

TABLE I-continued

| SEQ ID NO: | Name | Genbank Homology | Organism |
|---|---|---|---|
| 1797 | 2250-37 | PNP | H. sapiens |
| 1798 | 2250-42 | ORF_ID: o331#2 | E. coli |
| 1799 | 2250-44 | Extensin | E. coli |
| 1800 | 2250-47 | ORF o654 | E. coli |
| 1801 | 2250-48 | Gcap1 gene product | Mus musculus |
| 1802 | 2250-52 | similar to human MLH1 on chromosome 3p21 | Mus musculus |
| 1803 | 2250-53 | Hypothetical 27.6 kd protein in hpt-panD intergenic region. | E. coli |
| 1804 | 2250-58 | UmuC protein | E. coli |
| 1805 | 2250-61 | dJ134E15.1 (Blimp-1 | H. sapiens |
| 1806 | 2250-63 | ribosomal protein L23-related product homolog | Rattus rattus |
| 1807 | 2250-65 | hypothetical protein MJ1143 | E. coli |
| 1808 | 2250-68 | HI0025 homolog | E. coli |
| 1809 | 2250-77 | R34094_1 | H. sapiens |
| 1810 | 2250-78 | erythrocyte binding protein | Plasmodium yoelii |
| 1811 | 2250-79 | fosmidomycin resistance protein | E. coli |
| 1812 | 2250-81 | cyclophilin 1 | Drosophila |
| 1813 | 2250-83 | putative glutamine synthetase | E. coli |
| 1814 | 2251-3 | J (tail:host specificity; 1132) | Bacteriophage Lambda |
| 1815 | 2251-5 | Molybdopterin biosynthesis MoeB protein | E. coli |
| 1816 | 2251-6 | Fo-ATP synthase subunit b | Drosophila |
| 1817 | 2251-9 | citrate lyase alpha chain | E. coli |
| 1818 | 2251-10 | cuticle protein ACP65A | Drosophila |
| 1819 | 2251-13 | H repeat-associated protein in rhsC 3'region (orf-h3 | E. coli |
| 1820 | 2251-20 | glycine-rich protein | Arabadopsis thaliana |
| 1821 | 2251-23 | 2-oxoglutarate dehydrogenase precursor | H. sapiens |
| 1822 | 2251-29 | NFX1 | H. sapiens |
| 1823 | 2251-32 | ebgR product, repressor | E. coli |
| 1824 | 2251-41 | neural protein | Drosophila |
| 1825 | 2251-45 | similar to unidentified ORF | E. coli |
| 1826 | 2251-46 | NADH: ubiquinone oxido-reductase b17.2 subunit | Bos taurus |
| 1827 | 2251-49 | tyrosine kinase | Drosophila |
| 1828 | 2251-50 | coded for by C. elegans cDNA yk89e9.5 | C. elegans |
| 1829 | 2251-57 | H (tail component; 853) | Bacteriophage Lambda |
| 1830 | 2251-60 | Lysyl tRNA Synthetase | Drosophila |
| 1831 | 2251-62 | 7,8-diamino-pelargonic acid aminotransferase | E. coli |
| 1832 | 2251-64 | actin related protein | Drosophila |
| 1833 | 2252-6 | discs-large tumor suppressor | Drosophila |
| 1834 | 2252-16 | S-adenosylmethionine decarboxylase | E. coli |
| 1835 | 2252-17 | F52H3.5 | E. coli |
| 1836 | 2252-21 | translationally controlled tumor protein | Oryctolagus cuniculus |
| 1837 | 2252-31 | GTP binding protein | Rattus rattus |
| 1838 | 2252-34 | mitochondrial porin transcript 1 | Drosophila |
| 1839 | 2252-38 | cuticle protein | Manduca sexta |
| 1840 | 2252-39 | Similarity to Rat CD63 antigen | C. elegans |
| 1841 | 2252-41 | similar to S. cerevisiae Lpg20p | E. coli |
| 1842 | 2252-48 | cut E | E. coli |
| 1843 | 2252-61 | Histone H3 | Spisula solidissima |
| 1844 | 2252-66 | ea10 (ssb;122) | Bacteriophage Lambda |
| 1845 | 2252-71 | Mao C protein | E. coli |
| 1846 | 2252-72 | miniparomyosin | Drosophila |
| 1847 | 2252-73 | pherophorin-S | Volvox carteri |
| 1848 | 2252-80 | cyclophilin | Mus musculus |
| 1849 | 2252-84 | alternate gene name yhhG | E. coli |
| 1850 | 2222-20 | nucleoporin Nup98 | rat |
| 1851 | 2222-21 | hypothetical protein | Escherichia coli |
| 1852 | 2222-36 | ribosomal protein S11 | human |
| 1853 | 2222-39 | hypothetical protein PFB0315w | Plasmodium falciparans |
| 1854 | 2222-50 | serine/threonine-specific protein k. | Plasmodium falciparans |
| 1855 | 2222-58 | hypothetical protein C25E10.9 | C. elegans |
| 1856 | 2222-64 | transporting ATP synthase | bovine |
| 1857 | 2222-94 | tricarboxylate carrier | rat |
| 1858 | 2218-95 | anoxia upregulated protein | Drosophila melanogaster |

Table II represents a variety of flea HMT nucleic acid molecules of the present invention. Also cited in Table II are nucleic acid molecules from other organisms which share the closest sequence identity with the cited HMT sequences of the present invention, as determined by a search through the BLAST network as described above.

TABLE II

| SEQ ID NO: | Name | Genbank Homology | Organism |
|---|---|---|---|
| 171 | 2094-23 | mitochondrian ATP synthase, alpha subunit | Drosophila melanogaster |
| 172 | 2104-20 | mitochondrial ATP synthase | Drosophila melanogaster |
| 173 | 2105-14 | ATP synthase gamma-subunit | Homo sapiens |
| 174 | 2167-72 | oligomysin sensitivity conferring protein | Drosophila melanogaster |
| 175 | 2179-20 | ATPase 6 | Drosophila melanogaster |
| 176 | 2193-60 | ATP synthase subunit B | Schizaphis graminum |
| 177 | 2229-41 | ATP synthase alpha subunit | D. melanogaster |
| 178 | 2231-35 | 9 kD basic protein | D. melanogaster |
| 179 | 2231-47 | ATP synthase alpha-subunit | Bos taurus |
| 180 | 2232-95 | mitochondrial ATP synthase subunit 9 | Homo sapiens |
| 181 | 2084-56 | Late embryogenesis abundant protein | Picea glauca |
| 182 | 2084-36 | TGF-beta masking protein/ stranded at second | Drosophila melanogaster |
| 183 | 2086-2 | Argonaute protein | Arabidopsis thaliana |
| 184 | 2196-92 | like Drosophila HMPB homeotic proboscipedia protein | C. elegans |
| 185 | 2092-27 | DMDHEM2 | Drosophila melanogaster |
| 186 | 2094-21 | SeID protein | Drosophila melanogaster |
| 187 | 2106-11 | Unr | Rattus norvegicus |
| 188 | 2231-15 | cno (canoe) | D. melanogaster |
| 189 | 2230-79 | ALR homologue | D. melanogaster |
| 190 | 2232-42 | saxophone serine-threonine kinase receptor | D. melanogaster |
| 191 | 2232-68 | selenophosphate synthetase | D. melanogaster |
| 192 | 2088-11 | MMTAX107, TAX responsive element binding protein | Mus musculus |
| 193 | 2089-2 | cs Dna J-1 | Cucumis sativus |
| 194 | 2090-7 | Lethal (2) TID | Drosophila melanogaster |
| 195 | 2102-33 | monocytic leukaemia zinc finger protein | homo sapiens |
| 196 | 2105-26 | orf1 5' of EpoR | Mus musculus |
| 197 | 2106-6 | contains similarity to EGF-1 | C. elegans |
| 198 | 2106-9 | HSP70 protein | Ceratitis capitata |
| 199 | 2084-60 | 82 kD heat shock protein | Drosophila pseudobscura |
| 200 | 2108-59 | PAR domain protein | Drosophila melanogaster |
| 201 | 2156-34 | yk29g12.3 | C. elegans |
| 202 | 2161-17 | segmentation protein | Drosophila melanogaster |
| 203 | 2162-28 | heat shock protein 70, hsp70A2 | Anopheles albimanus |
| 204 | 2187-18 | Heat shock protein 70 | Anopheles albimanus |
| 205 | 2173-77 | Heat shock protein hsp70 | D. melanogaster |
| 206 | 2165-30 | nucleolar protein | Drosophila melanogaster |

TABLE II-continued

| SEQ ID NO: | Name | Genbank Homology | Organism |
|---|---|---|---|
| 207 | 2165-59 | contains similarity to C4-type zinc fingers | C. elegans |
| 208 | 2177-80 | zinc finger protein | Mus musculus |
| 209 | 2181-45 | PAR domain protein 1 | Drosophila melanogster |
| 210 | 2185-9 | Heat shock protein-70 | Anopheles albimanus |
| 211 | 2185-82 | segmentation protein | Drosophila melanogaster |
| 212 | 2188-33 | transcriptional represser protein | Drosophila melanogaster |
| 213 | 2203-18 | Mastermind | Drosophila virilis |
| 214 | 2205-82 | high mobility group protein 1a | Chironomus tentans |
| 215 | 2230-26 | DNA repair protein | D. melanogaster |
| 216 | 2230-71 | homologue of seven in absentia | Homo sapiens |
| 217 | 2230-89 | nuclear speckle-type protein, SPOP | Homo sapiens |
| 218 | 2230-96 | heat shock protein | D. melanogaster |
| 219 | 2231-7 | hypothetical protein | S. pombe |
| 220 | 2231-38 | Rad51 homolog | Bombyx mori |
| 221 | 2231-81 | DNA repair protein | D. melanogaster |
| 222 | 2232-2 | cellular nucleic acid binding protein | Xenopus laevis |
| 223 | 2234-63 | heat shock protein 70 | Trichoplusia ni |
| 224 | 2232-77 | actin-binding double-zinc-finger protein (abLIM) | Homo sapiens |
| 225 | 2234-78 | DNA-binding protein isoform I | D. melanogaster |
| 226 | 2084-48 | Allantoinase | Rana catesbeiana |
| 227 | 2085-22 | beta-glucuronidase | E. coli |
| 228 | 2094-24 | prolidase = peptidaseD/imidopeptidase | Mus musculus |
| 229 | 2088-43 | branched chain alpha-keto acid dehydrogenase E1-beta subunit | Bos taurus |
| 230 | 2086-29 | 3-hydroxyisobutyrate dehydrogenase | Dictyostelium discoideum |
| 231 | 2088-5 | Rab 5c protein | Canis familiaris |
| 232 | 2095-17 | cytochrome P-450 | Heliothis virescens |
| 233 | 2102-16 | carbamoyl phosphate synthetase II | Plasmodium falciparans |
| 234 | 2102-48 | NADPH cytochrome P450 reductase | Musca domestica |
| 235 | 2104-15 | branched chain alpha-keto acid dehydrogenase | Rattus norvegicus |
| 236 | 2106-5 | Metallothionein | Strongylocentrotus purpuratus |
| 237 | 2106-47 | peroxidoxin-1 | Dirofilaria immitis |
| 238 | 2107-17 | tetracycline transporter-like protein | Mus musculus |
| 239 | 2107-58 | allergen Bla g 5 (glutathione-S-transferase) | Blattella germanica |
| 240 | 2156-58 | HAL-3 homologue | Arabidopsis thaliana |
| 241 | 2195-90 | aminoacyclase-1 | Homo sapiens |
| 242 | 2171-55 | NADPH - ferrihemoprotein reductase | Drosophila melanogaster |
| 243 | 2169-30 | hypothetical protein | Synechocystis sp |
| 244 | 2169-52 | insulin degrading enzyme | Drosophila melanogaster |
| 245 | 2177-64 | 3-hydroxyisobutyrate dehydrogenase | Rattus norvegicus |
| 246 | 2181-69 | Endonexin | Bos taurus |
| 247 | 2138-25 | glutamate dehydrogenase | Drosophila melanogaster |
| 248 | 2230-28 | glutathione-S-transferase | Anopheles gambiae |
| 249 | 2191-8 | lactase-phlorizin hydrolase | Rattus rattus |
| 250 | 2193-52 | cytochrome P450 | Heloithis virescens |
| 251 | 2202-35 | glutathione-S-transferase | Anopheles gambiae |
| 252 | 2229-77 | glutathione-S-transferase | Anopheles gambiae |
| 253 | 2229-81 | urate oxidase | D. melanogaster |
| 254 | 2231-42 | superoxide dismutase | Cervus elaphus |
| 255 | 2232-74 | allergen Bla g 5 | Blattella germanica |
| 256 | 2234-42 | glutathione reductase family | Musca domestica |
| 257 | 2087-8 | cystic fibrosis transmembrane conductance regulator | Homo sapiens |
| 258 | 2087-23 | Nervous system antigen 2 | Drosophila melanogaster |
| 259 | 2091-56 | adenosine triphosphatase | Homo sapiens |
| 260 | 2094-20 | sodium pump, alpha suhbunit | Ctenocephalides felis |
| 261 | 2095-51 | similar to Hrs | C. elegans |
| 262 | 2103-24 | N-methyl-D-aspartate receptor-associated protein | Drosophila melanogaster |
| 263 | 2105-55 | inward rectifying K channel | Sus scrofa |
| 264 | 2105-63 | EF-hand Ca2+ binding protein p22 | Rattus norvegicua |
| 265 | 2106-62 | Dents disease candidate gene product | Homo sapiens |
| 266 | 2167-50 | PKD1 (polycystic kidney disease 1) | Fugu rubripes |
| 267 | 2185-37 | copper-transporting ATPase | Archaeoglobus fulgidus |
| 268 | 2193-29 | TrkG Potassium transport protein | E. coli |
| 269 | 2195-33 | silicon transporter | Cylindrotheca fusiformis |
| 270 | 2202-16 | similarity to human sulfate anion transporter | C. elegans |
| 271 | 2230-2 | sulfate transporter | Arabidopsis thaliana |
| 272 | 2230-69 | mitochondrial porin | D. melanogaster |
| 273 | 2231-22 | muscarinic acetylcholine receptor | D. melanogaster |
| 274 | 2231-24 | p97 subunit of 15S Mg(2+)- ATPase | Xenopus laevis |
| 275 | 2231-32 | anion transporting ATPase | Aquifex aeolicus |
| 276 | 2231-70 | sulfate permease | Schizosaccharomyces pombe |
| 277 | 2231-94 | putative Na/H exchanger | S. pombe |
| 278 | 2233-6 | plasma membrane Ca2+-ATPase 2 | Mus musculus |
| 279 | 2233-24 | chloride channel gene, CLIC2 | Homo sapiens |
| 280 | 2085-61 | beta-type protein kinase C | Bos taurus |
| 281 | 2089-20 | cGMP-dependent protein kinase | Drosophila melanogaster |
| 282 | 2092-12 | Btk | Homo sapiens |
| 283 | 2093-64 | Receptor-like protein tyrosine phosphatase | Drosophila melanogaster |
| 284 | 2095-31 | frt (fms-related tyrosine kinase gene) | Homo sapiens |
| 285 | 2094-58 | casein kinase II beta | Oryctolagus cuniculus |
| 286 | 2103-54 | ORF YGL084c | Saccharomyces cerevisiae |
| 287 | 2106-42 | protein phosphatase epsilon subunit | Homo sapiens |
| 288 | 2156-5 | serine/threonine kinase | Rattus norvegicus |
| 289 | 2157-95 | cGMP-dependent protein kinase | Drosophila melanogaster |
| 290 | 2165-80 | ABL gene product | Gallus gallus |
| 291 | 2165-63 | diadenosine tetraphosphatase | Homo sapiens |
| 292 | 2167-17 | adenylate cyclase | S. cereviciae |
| 293 | 2177-44 | serine/threonine kinase | C. elegans |
| 294 | 2188-16 | weakly similar to serine/threonine kinase | C. elegans |
| 295 | 2191-60 | carbohydrate kinase, pfkB family | Archaeoglobus fulgidus |
| 296 | 2195-22 | protein kinase | Drosophila melanogaster |
| 297 | 2196-30 | calcium-dependent protein kinase | A. thaliana |
| 298 | 2205-83 | protein kinase/endoribonulcease (IRE1) | Homo sapiens |
| 299 | 2205-87 | receptor tyrosine phosphatase | Hirudo medicinalis |
| 300 | 2229-11 | magnesium-dependent calcium inhibitable phosphatase | Bos taurus |
| 301 | 2229-25 | phosphoglycerate kinase | Schistosoma mansoni |
| 302 | 2229-74 | pyruvate kinase | D. melanogaster |
| 303 | 2230-55 | serine/threonine specific protein phosphatase 4 | D. melanogaster |
| 304 | 2230-57 | stress activated MAP kinase kinase 3 | D. melanogaster |
| 305 | 2231-64 | alkaline phosphatase | D. melanogaster |
| 306 | 2231-91 | olynucleotide phosphorylase | Yersinia enterocolitica |
| 307 | 2232-43 | protein kinase PkwA | Thermomonospora curvata |

TABLE II-continued

| SEQ ID NO: | Name | Genbank Homology | Organism |
|---|---|---|---|
| 308 | 2234-94 | serine/threonine kinase ULK1 | Homo sapiens |
| 309 | 2085-18 | Pyridoxamine phosphate oxidase | C. elegans |
| 310 | 2094-13 | sphingomyelin phosphodiesterase | Mus musculus |
| 311 | 2105-47 | apolipoprotein E receptor 2 | Homo sapiens |
| 312 | 2092-38 | squalene synthetase | Homo sapiens |
| 313 | 2094-25 | fatty acid synthetase | Rattus norvegicus |
| 314 | 2089-32 | coproporphyrinogen oxidase | Homo sapiens |
| 315 | 2085-46 | HADHB mitochondrial tri-functional protein beta subunit | Homo sapiens |
| 316 | 2104-56 | pyridoxal kinase | Homo sapiens |
| 317 | 2107-30 | Phosphomevalonate kinase | Homo sapiens |
| 318 | 2154-70 | very-long chain acyl-CoA dehydrogenase | Mus musculus |
| 319 | 2191-85 | stearyl-CoA desaturase | Cyprinus carpio |
| 320 | 2192-44 | very-long-chain Acyl-CoA dehydrogenase | Rattus norvegicus |
| 321 | 2195-55 | Similar to LDL receptor-related protein | C. elegans |
| 322 | 2229-82 | lipase-3 | D. melanogaster |
| 323 | 2231-59 | Phosphatidylethanolamine-binding protein | Macaca fascicularis |
| 324 | 2233-25 | similarity to yeast ethanolamine-phosphotransferase | C. elegans |
| 325 | 2233-41 | cellular retinoic acid binding protein (mCRABP) | Manduca sexta |
| 326 | 2087-61 | I allergen | Lepidoglyphus destructor |
| 327 | 2087-41 | chloroquine resistance candidate protein | Plasmodium falciparum |
| 328 | 2089-51 | Xenopus Bf B | Xenopus laevis |
| 329 | 2086-58 | repeat organellar protein | Plasmodium falciparum |
| 330 | 2090-45 | heat shock cognate protein | Drosophila melanogaster |
| 331 | 2104-23 | 40 kDa heat shock chaperone protein | Deinococcus |
| 332 | 2107-26 | Luciferase | Photuris pennsylvanica |
| 333 | 2162-46 | F20D1.9 | C. elegans |
| 334 | 2162-49 | PKR inhibitor P58 | Bos taurus |
| 335 | 2162-93 | GroES homologue | Ricketsia |
| 336 | 2171-46 | NH2 terminus uncertain | Leishmania tarentolae |
| 337 | 2089-10 | beta adaptin | Drosophila melanogaster |
| 338 | 2229-24 | non-functional folate binding protein | Homo sapiens |
| 339 | 2229-25 | calmodulin B | Halocynthia roretzi |
| 340 | 2229-31 | putative T1/ST2 receptor binding protein | C. elegans |
| 341 | 2229-36 | alpha-crystallin cognate protein 25 | Plodia interpunctella |
| 342 | 2229-40 | Defensin | Apis mellifera |
| 343 | 2229-86 | glutamate-ammonia ligase | D. melanogaster |
| 344 | 2231-49 | melanoma-associated antigen ME491 | Homo sapiens |
| 345 | 2231-76 | histone C | Drosophila virilis |
| 346 | 2232-65 | translationally controlled tumor protein | Oryctolagus cuniculus |
| 347 | 2232-84 | Apyrase | Aedes aegypti |
| 348 | 2232-85 | KIAA0124 | Homo sapiens |
| 349 | 2233-59 | Glutamine-dependent carbamoyl-phosphate synthase | C. elegans |
| 350 | 2233-86 | ANG12 precursor | Anopheles gambiae |
| 351 | 2234-11 | tissue specific secretory protein | Pan troglodytes |
| 352 | 2234-76 | methionine adenosyltransferase | D. melanogaster |
| 353 | 2089-13 | Synaptic vessicle protein 2 form B | Rattus norvegicus |
| 354 | 2159-52 | glycoprotein 56 | Rattus norvegicus |
| 355 | 2084-6 | CLN3; homologue of the gene underlying Batten disease | Mus musculus |
| 356 | 2085-10 | Amphiphysin | Gallus gallus |
| 357 | 2156-39 | glycoprotein 55 | Rattus norvegicus |
| 358 | 2104-59 | Transmembrane transporter | Discopyge ommata |
| 359 | 2105-9 | insect intestinal mucin II | Trichoplusia ni |
| 360 | 2106-14 | kinesin-like protein | D. melanogaster |
| 361 | 2107-45 | Lazarillo precursor | Schistocerca americana |
| 362 | 2156-3 | clathrin-associated protein | Mus musculus |
| 363 | 2161-46 | neural variant mena+ protein | Mus musculus |
| 364 | 2171-92 | Malvolio | Drosophila melanogaster |
| 365 | 2175-18 | homolog of SYT—synaptotagmin | Mus musculus |
| 366 | 2177-10 | GABA receptor subunit (Rdl) | Aedes aegypti |
| 367 | 2181-10 | neurexin IV | Drosophila melanogaster |
| 368 | 2191-92 | synaptic vessicle protein 2B | Rattus norvegicus |
| 369 | 2229-18 | Synaptic vessicle protein 2A | Rattus norvegicus |
| 370 | 2194-38 | gamma-subunit of mouse nerve growth factor | Mus musculus |
| 371 | 2230-60 | lin-7-C | Rattus norvegicus |
| 372 | 2230-81 | PDZ domain protein | Homo sapiens |
| 373 | 2234-5 | Gcap1 gene product | Mus musculus |
| 374 | 2234-55 | Gcap1 gene product | Mus musculus |
| 375 | 2234-71 | Gcap1 gene product | Mus musculus |
| 376 | 2085-34 | Liver-specific transport protein | Rattus norvegicus |
| 377 | 2087-15 | polyspecific organic cation transporter | Homo sapiens |
| 378 | 2204-80 | transmembrane transporter | Discopyge ommatta |
| 379 | 2093-39 | liver-specific transport protein | Rattus norvegicus |
| 380 | 2093-46 | similar to monocarboxylate transporter family | C. elegans |
| 381 | 2092-22 | similar to matrin F/G | C. elegans |
| 382 | 2103-50 | Unknown | Drosophila melanogaster |
| 383 | 2103-51 | organic cation transporter | Ratttus norvegicus |
| 384 | 2197-35 | renal organic cation transporter | Oryctolagus cuniculus |
| 385 | 2156-17 | sulfate anion transporter | Manduca sexta |
| 386 | 2166-84 | LX1 | Mus musculus |
| 387 | 2167-94 | MCT (monocarboxylate transporter) | Homo sapiens |
| 388 | 2196-83 | renal organic cation transporter | Oryctolagus cuniculus |
| 389 | 2229-83 | similarity to monocarboxylate transporter 1 | C. elegans |
| 390 | 2231-89 | Golgi 4-transmembrane spanning transporter MTP | Mus musculus |
| 391 | 2158-8 | phosphate carrier protein | C. elegans |
| 392 | 2085-14 | ADP/ATP translocase | Drosophila melanogaster |
| 393 | 2085-17 | Na+-dependent inorganic phosphatase cotransporter | Drosophila melanogaster |
| 394 | 2088-38 | ADP/ATP translocase | Bos taurus |
| 395 | 2092-50 | ADP/ATP translocase | Drosophila melanogaster |
| 396 | 2104-21 | Na(+)-dependent inorganic phosphate cotransporter | Drosophila melanogaster |
| 397 | 2121-55 | phosphate carrier protein | C. elegans |
| 398 | 2105-64 | phosphate carrier protein | Homo sapiens |
| 399 | 2102-6 | ZK512.6 | C. elegans |
| 400 | 2108-27 | mitochondrial phosphate carrier protein | Homo sapiens |
| 401 | 2194-63 | mitochondrial phosphate transporter | Rattus norvegicus |
| 402 | 2196-14 | phosphate/triose-phosphate translocator precursor | C. elegans |
| 403 | 2204-11 | EST clone | D. melanogaster |
| 404 | 2085-16 | Chymotrypsin I | Anopheles gambiae |
| 405 | 2085-54 | Chymotrypsin II | Anopheles gambiae |
| 406 | 2086-12 | Plasminogen | Homo sapiens |
| 407 | 2086-18 | Trypsin eta | Drosophila melanogaster |
| 408 | 2090-21 | Trypsin | Manduca sexta |
| 409 | 2092-15 | Alp1 | Cochliobolus carbonum |
| 410 | 2102-11 | vitellin-degrading protease | Bombyx mori |
| 411 | 2102-17 | Chymotrypsin II | Anopheles gambiae |
| 412 | 2102-51 | chymotrypsin -like protease | Anopheles gambiae |
| 413 | 2103-31 | Beta trypsin | Drosophila erecta |

TABLE II-continued

| SEQ ID NO: | Name | Genbank Homology | Organism |
|---|---|---|---|
| 414 | 2107-22 | Factor IX | Rattus norvegicus |
| 415 | 2108-29 | Trypsin | Anopheles stephensi |
| 416 | 2157-15 | Trypsin | Choristoneura fumiferana |
| 417 | 2160-34 | Aminopeptidase | Synechocystis |
| 418 | 2160-36 | E01G6.1 | C. elegans |
| 419 | 2103-62 | plasminogen activator inhibitor 2 | Mus musculus |
| 420 | 2167-36 | factor IX | Oryctolagus cuniculus |
| 421 | 2167-67 | Alp1 | Cochliobolus carbonum |
| 422 | 2169-51 | Trypsin | Aedes aegypti |
| 423 | 2181-27 | Chymotrypsin BII | Penaeus vannamei |
| 424 | 2185-69 | plasma prekallikrein | Homo sapeins |
| 425 | 2187-20 | pre-procathepsin L | Paragonimus westermani |
| 426 | 2188-45 | vitellin-degrading protease | Bombyx mori |
| 427 | 2192-91 | late trypsin precourser | Culex pipiens quinquefasciatus |
| 428 | 2196-10 | SPC2 | Branchiostoma californiensis |
| 429 | 2196-88 | Trypsin | Anopheles stephensi |
| 430 | 2204-9 | carnitine/choline acetyltransferase | C. elegans |
| 431 | 2229-7 | iota trypsin | D. melanogaster |
| 432 | 2229-22 | Trypsin | Anopheles gambiae |
| 433 | 2229-89 | Trypsin | Anopheles gambiae |
| 434 | 2229-94 | late trypsin precourser | Culex pipiens quinquefasciatus |
| 435 | 2230-59 | Chymotrypsin 1 | Anopheles gambiae |
| 436 | 2230-67 | carboxypeptidase A | Drosophila heteroneura |
| 437 | 2231-62 | aminopeptidase N | Sus scxrofa |
| 438 | 2231-74 | limulus factor C serine protease | Tachypleus tridentatus |
| 439 | 2232-15 | cysteine proteinase | Sitophilus zeamais |
| 440 | 2232-25 | Carboxypeptidase | Simulium vitatum |
| 441 | 2232-33 | putative aspartic protease | Brassica oleracea |
| 442 | 2233-46 | aminopeptidase N | Pleuronectes americanus |
| 443 | 2233-85 | chymotrypsin 1 | Anopheles gambiae |
| 444 | 2233-90 | Trypsin | Anopheles stephensi |
| 445 | 2233-94 | preprechymotrypsin 1 | Penaeus vannamei |
| 446 | 2234-29 | chymotrypsin-like protease precursor | Aedes aegypti |
| 447 | 2234-58 | Putative | C. elegans |
| 448 | 2234-61 | carboxylesterase precursor | Aphis gossypii |
| 449 | 2234-68 | serine protease inhibitor I | Schistocerca gregaria |
| 450 | 2084-35 | Integral membrane protein | Mus musculus |
| 451 | 2086-45 | similar to beta-ureidopropionase of Rat | C. elegans |
| 452 | 2087-54 | Cyclin | Mus musculus |
| 453 | 2088-22 | Esp 8 | Mus musculus |
| 454 | 2091-16 | contains similarity to EGF-like domains | C. elegans |
| 455 | 2091-29 | multiple exostosis-like protein | Homo sapiens |
| 456 | 2091-30 | apoptosis 1 inhibitor | Drosophila melanogaster |
| 457 | 2092-33 | KIAA0023 (putitive oncogene) | Homo sapiens |
| 458 | 2095-35 | G coupled receptor | C. elegans |
| 459 | 2095-3 | Go (heterotrimeric guanyl nucleotide binding protein alpha subunit) | Manduca sexta |
| 460 | 2085-4 | gp 150 protein | Drosophila melanogaster |
| 461 | 2103-28 | leukotriene A4 hydrolase | Rattus sp. |
| 462 | 2105-62 | putitive orf | Homo sapiens |
| 463 | 2107-6 | activator protein | Drosophila melanogaster |
| 464 | 2107-28 | platelet-endothelial tetraspan antigen 3 | Homo sapiens |
| 465 | 2189-3 | oligopeptidase A (prIC) | Haemopholis influenzea |
| 466 | 2156-54 | fibroblast growth factor receptor | Xenopus laevis |
| 467 | 2160-92 | contains similarity to EGF-like domains | C. elegans |
| 468 | 2160-65 | weak similarity to the drosophila hyperplastic disc protein | C. elegans |
| 469 | 2165-53 | inositol triphosphate receptor | Rattus norvegicus |
| 470 | 2166-22 | placental protein 11 | Homo sapiens |
| 471 | 2166-92 | elongation factor 1 alpha-like | Drosophila melanogaster |
| 472 | 2181-34 | DSch | Drosophila melanogaster |
| 473 | 2192-65 | STAM, signal transducing adaptor molecule | Homo sapiens |
| 474 | 2194-24 | ATPases associated with various cellular activities (AAA family) | Arabidopsis thaliana |
| 475 | 2196-75 | similar to cell division control protein | C. elegans |
| 476 | 2230-38 | EST clone | S. cereviciae |
| 477 | 2230-39 | NTPase | D. melanogaster |
| 478 | 2230-66 | adenylyl cyclase aggregation protein | Dictyostelium discoideum |
| 479 | 2230-80 | sphingomyelin phosphodiesterase | C. elegans |
| 480 | 2231-29 | nuclear antigen H731 | Homo sapiens |
| 481 | 2231-40 | suppressor of actin mutation 2 | Homo sapiens |
| 482 | 2231-66 | DET1 | Arabidopsis thaliana |
| 483 | 2232-7 | Calreticulin | D. melanogaster |
| 484 | 2232-38 | activator protein | D. melanogaster |
| 485 | 2232-69 | ornithine decarboxylase | Gallus gallus |
| 486 | 2233-32 | similar bHLH-PAS | D. melanogaster |
| 487 | 2233-45 | rab1 | D. melanogaster |
| 488 | 2234-2 | C10A gene product | Mus musculus |
| 489 | 2234-72 | QM homolog | D. melanogaster |
| 490 | 2084-17 | Integral membrane protein | Herpesvirus-2 |
| 491 | 2091-4 | endomembrane protien EMP70 precourser isolog | Arabidopsis thaliana |
| 492 | 2102-45 | Ylr251wp | Saccharomyces cerevisiae |
| 493 | 2162-68 | 220 kDa silk protein | Chironomus thummi |
| 494 | 2160-47 | precursor HT7 protein | Gallus gallus |
| 495 | 2161-12 | peritrophin 95 precourser | Lucilia cuprina |
| 496 | 2161-15 | yk86g11.5 | C. elegans |
| 497 | 2171-12 | 51A surface protein | Paramecium tetraurelia |
| 498 | 2173-18 | hypothetical - mitochondrial membrane transport protein | Schizosaccharomyces pombe |
| 499 | 2087-32 | est sequence | C. elegans |
| 500 | 2091-19 | Similar to P. aeruginosa hypothetical protein | C. elegans |
| 501 | 2192-86 | tyrosine kinase | Drosophila melangaster |
| 502 | 2086-42 | M04B2.4 | C. elegans |
| 503 | 2088-16 | glycoprotein 330 | C. elegans/Human |
| 504 | 2088-39 | EST sequence | Arabidopsis thaliana |
| 505 | 2088-57 | Yer 126cp | Saccharomyces cereviciae |
| 506 | 2089-25 | similar to S. cereviciae hypothetical protein YKL166 | C. elegans |
| 507 | 2090-3 | EST sequence | Saccharomyces cereviciae |
| 508 | 2090-53 | EST sequence | C. elegans |
| 509 | 2095-20 | Chloroplast ORF | Marchantia polymorpha |
| 510 | 2102-28 | similar to S. cerevisiae hypothetical protein YKL166 | C. elegans |
| 511 | 2102-55 | D1054.3 | C. elegans |
| 512 | 2102-58 | ZC513.5 gene product | C. elegans |
| 513 | 2105-44 | E 1087 protein | Saccharomyces cereviciae |
| 514 | 2109-24 | F11C1.5 | C. elegans |
| 515 | 2154-21 | disulfide-like protein | Acanthamoeba castellanii |
| 516 | 2156-6 | ZK470.1 | C. elegans |
| 517 | 2156-18 | BIIIA3 | Ovis aries |
| 518 | 2156-27 | AFR1 | S. cereviciae |
| 519 | 2165-94 | COS41.8 | Ciona intestinalis |
| 520 | 2167-65 | EST sequence, function unknown | C. elegans |
| 521 | 2171-93 | KIAA0160 | Homo sapiens |
| 522 | 2175-45 | ORF YJR83.18 | S. cereviciae |

TABLE II-continued

| SEQ ID NO: | Name | Genbank Homology | Organism |
|---|---|---|---|
| 523 | 2185-66 | rps4 | Plasmodium falciparum |
| 524 | 2195-40 | C27C12.4 | C. elegans |
| 525 | 2196-20 | glycoprotein A | Pneumocystis carinii |
| 526 | 2205-89 | BKRF1 encodes EBNA-1 protein | Epstein Barr virus |
| 527 | 2229-19 | D4L | Variola virus |
| 528 | 2230-35 | KIAA0747 | Homo sapiens |
| 529 | 2231-8 | I3 | Mus musculus |
| 530 | 2231-78 | unknown protein | Arabidopsis thaliana |
| 531 | 2232-49 | Similarity to Yeast hypothetical 52.9 KD protein | C. elegans |
| 532 | 2232-52 | tetratricopeptide repeat protein (tpr2) | Homo sapiens |
| 533 | 2233-5 | similar to Saccharomyces cerevisiae SCD6 protein | C. elegans |
| 534 | 2233-22 | cDNA EST yk486b9.3 | C. elegans |
| 535 | 2233-93 | CDC27Dm | D. melanogaster |
| 536 | 2084-34 | Immune suppressor/V-ATPase 115 kDa subunit | Mus musculus |
| 537 | 2086-30 | V-ATPase A-subunit | Aedes aegypti |
| 538 | 2087-45 | H+ ATPase | Drosophila melanogaster |
| 539 | 2088-55 | 40-kDa-V-ATPase subunit | Manduca sexta |
| 540 | 2088-62 | vacuolar ATPase subunit A | Drosophila melanogaster |
| 541 | 2091-26 | proton-ATPase-like protein | Homo sapiens |
| 542 | 2091-31 | vacuolar ATPase subunit A | Drosophila melanogaster |
| 543 | 2092-20 | vacuolar ATPase 115 kDa subunit | Homo sapiens |
| 544 | 2095-18 | similar to S. cereviciae vacuolar H(+)-ATPase 54 kD subunit | C. elegans |
| 545 | 2095-54 | H (+)-transporting ATPase subunit B | Manduca sexta |
| 546 | 2108-8 | similar to S. cereviciae 54 kDa V-ATPase subunit | C. elegans |
| 547 | 2154-36 | V-ATPase subunit E | Drosophila melanogaster |
| 548 | 2154-76 | V-ATPase subunit A (new fragment) | Aedes aegypti |
| 549 | 2166-32 | V-ATPase C subunit | Drosophila melanogaster |
| 550 | 2166-33 | vacuolar (V-type) H(+)-ATPase B subunit | Helicoverpa virescens |
| 551 | 2166-90 | beta subunit of ATPase | Schizaphis graminum |
| 552 | 2161-5 | ATPase I | Plasmodium falciparum |
| 553 | 2171-24 | similar to V-ATPase 116 kd subunit | C. elegans |
| 554 | 2169-82 | V-ATPase subunit E | Drosophila melanogaster |
| 555 | 2187-36 | V-ATPase membrane sector associated protein M8-9 | Homo sapiens |
| 556 | 2188-91 | V-ATPase subunit A | Candida tropicalis |
| 557 | 2230-88 | vacuolar ATPase G subunit | Manduca sexta |
| 558 | 2232-61 | V-ATPase subunit C | D. melanogaster |
| 559 | 2086-52 | Penelope transposable element ORF | Drosophila virilis |
| 560 | 2103-2 | genome polyprotein gene product | Plum pox virus |
| 561 | 2106-8 | pol protein | Human T-cell lympho-tropic virus type 2 |
| 562 | 2108-41 | reverse transcriptase, Doc retroposon | Drosophila melanogaster |
| 563 | 2202-28 | Polyprotein | Hepatitis virus C |
| 564 | 2165-95 | DNA polymerase | Choristoneura biennis entomopoxvirus |
| 565 | 2169-81 | reverse transcriptase | Drosophila melanogaster |
| 566 | 2181-36 | reverse transcriptase | Anopheles gambiae |
| 1416 | 2240-4 | alpha-L-fucosidase precursor | Homo sapiens |
| 1417 | 2240-11 | estrogen related receptor alpha | Mus musculus |
| 1418 | 2240-14 | NADH: ubiquinone oxido-reductase 51-kD subunit | Homo sapiens |
| 1419 | 2240-17 | peritrophin 1 | Anopheles gambiae |
| 1420 | 2240-19 | small GTPase rac1b | Homo sapiens |
| 1421 | 2240-23 | Symplekin | Homo sapiens |
| 1422 | 2240-26 | ribosomal protein L30 | Bos taurus |
| 1423 | 2240-28 | 60S Ribosomal Protein RPL10A | Homo sapiens |
| 1424 | 2240-29 | KIN17 protein | D. melanogaster |
| 1425 | 2240-31 | eukaryotic initiation factor 4 gamma | Homo sapiens |
| 1426 | 2240-38 | ornithine decarboxylase antizyme | D. melanogaster |
| 1427 | 2240-44 | electron transfer flavoprotein | Rattus norvegicus |
| 1428 | 2240-53 | EST clone | C. elegans |
| 1429 | 2240-55 | glutathione reductase family | Musca domestica |
| 1430 | 2240-58 | chymotrypsin-like serine protease | C. felis |
| 1431 | 2240-63 | ferritin subunit 1 | D. melanogaster |
| 1432 | 2240-64 | vacuolar ATPase subunit B | D. melanogaster |
| 1433 | 2240-66 | chaperonin containing TCP-1 delta | Fugu rubripes |
| 1434 | 2240-70 | 1-acyl-glycerol-3-phosphate acyltransferase | Zea mays |
| 1435 | 2240-71 | EST clone AL021106 | D. melanogaster |
| 1436 | 2240-72 | 376aa long hypothetical dehydrogenase | Pyrococcus horikoshii |
| 1437 | 2240-77 | chymotrypsin-like serine protease | C. felis |
| 1438 | 2240-80 | EST clone | C. elegans |
| 1439 | 2240-83 | chymotrypsin-like serine protease | C. felis |
| 1440 | 2240-90 | cytochrome P450 | D. melanogaster |
| 1441 | 2240-93 | enhancer-trap-locus-1 | Mus musculus |
| 1442 | 2240-94 | glycerol-3-phosphate dehydrogenase | Ceratitis capitata |
| 1443 | 2241-3 | FS-H precourser | Ctenocephalides felis |
| 1444 | 2241-5 | trypsin-like serine protease | Ctenocephalides felis |
| 1445 | 2241-7 | myospheroid protein | D. melanogaster |
| 1446 | 2241-10 | Sam50 | D. melanogaster |
| 1447 | 2241-12 | NADH dehydrogenase subunit 2 | Chorthippus parallelus |
| 1448 | 2241-15 | putative protein | Arabidopsis thaliana |
| 1449 | 2241-16 | contains EGF-like repeats | C. elegans |
| 1450 | 2241-20 | Gcap1 gene product | Mus musculus |
| 1451 | 2241-25 | Na(+)-dependent inorganic phosphate cotransporter | D. melanogaster |
| 1452 | 2241-31 | D4L | Variola virus |
| 1453 | 2241-36 | plenty-of-prolines-101; POP101; SH3-philo-protein | Mus musculus |
| 1454 | 2241-40 | EF-1-alpha | D. melanogaster |
| 1455 | 2241-44 | F1-ATP synthase epsilon-subunit | Ipomoea batatas |
| 1456 | 2241-54 | ribosomal protein S28 | Homo sapiens |
| 1457 | 2241-55 | Y-box protein | D. melanogaster |
| 1458 | 2241-56 | short-chain alcohol dehydrogenase | Homo sapiens |
| 1459 | 2241-59 | contains 3 cysteine rich repeats | C. elegans |
| 1460 | 2241-60 | muscle type phosphofructokinase | Canis familiaris |
| 1461 | 2241-61 | Heat shock protein 82 | Mus musculus |
| 1462 | 2241-65 | chymotrypsin-like protease | C. felis |
| 1463 | 2241-66 | Oligosaccharyltransferase subunit | D. melanogaster |
| 1464 | 2241-70 | EST clone | D. melanogaster |
| 1465 | 2241-72 | failed axon connections protein | D. melanogaster |
| 1466 | 2241-74 | Enolase | Hymenolepis diminuta |
| 1467 | 2241-78 | multiple exostosis 2 protein | Mus musculus |
| 1468 | 2241-80 | Protein on Ecdysone Puffs | D. melanogaster |
| 1469 | 2241-82 | paramyosm | D. melanogaster |
| 1470 | 2241-83 | beta-tubulin | Bombyx mori |
| 1471 | 2241-84 | natural killer cell enhancing factor | Cyprinus carpio |
| 1472 | 2241-86 | similar to MYOTUBULARIN-RELATED PROTEIN | Homo sapiens |
| 1473 | 2241-87 | Renin | Rattus norvegicus |
| 1474 | 2241-90 | Myophilin | Echinococcus multilocularis |
| 1475 | 2243-10 | alpha-actinin | D. melanogater |
| 1476 | 2243-11 | monocarboxylate transporter | Homo sapiens |

TABLE II-continued

| SEQ ID NO: | Name | Genbank Homology | Organism |
|---|---|---|---|
| 1477 | 2243-13 | yk278a10.3 | *C. elegans* |
| 1478 | 2243-15 | selenium donor protein | *Homo sapiens* |
| 1479 | 2243-18 | acetyl-CoA synthetase | *D. melanogater* |
| 1480 | 2243-20 | cytochrome P450 CYP12A3 | *Musca domestica* |
| 1481 | 2243-22 | NADH dehydrogenase subunit 4 | *Anopheles arabiensis* |
| 1482 | 2243-27 | Polyubiquitin | *Cricetulus griseus* |
| 1483 | 2243-28 | Moesin | *D. melanogater* |
| 1484 | 2243-31 | QM protein | *Bombyx mandarina* |
| 1485 | 2243-32 | Sec23 protein | *Homo sapiens* |
| 1486 | 2243-37 | truncated protein | *S. cereviciae* |
| 1487 | 2243-38 | Projectin | *D. melanogater* |
| 1488 | 2243-39 | Unknown | *Homo sapiens* |
| 1489 | 2243-41 | similar to enoyl-CoA hydratase | *C. elegans* |
| 1490 | 2243-45 | similar to dehydrogenase | *C. elegans* |
| 1491 | 2243-46 | trypsin-like serine protease | *C. felis* |
| 1492 | 2243-48 | Merlin | *Rattus norvegicus* |
| 1493 | 2243-52 | GTP-specific succinyl-CoA synthetase beta subunit | *Homo sapiens* |
| 1494 | 2243-53 | sod protein (superoxide dismutase) | *Drosophila virilis* |
| 1495 | 2243-54 | trypsin-like serine protease | *C. felis* |
| 1496 | 2243-61 | chymotrypsin-like serine protease | *C. felis* |
| 1497 | 2243-66 | Tag B | *Dictyostelium discoideum* |
| 1498 | 2243-67 | hypothetical protien | *Arabidopsis thaliana* |
| 1499 | 2243-68 | heat shock cognate protein 70 | *Trichoplusia ni* |
| 1500 | 2243-72 | TRIP-1 homologue | *D. melanogater* |
| 1501 | 2243-73 | cytosolic NADP-dependent iso-citrate dehydrogenase | *Microtis mexicanis* |
| 1502 | 2243-86 | progesterone-induced protein | *Oryctolagus cuniculus* |
| 1503 | 2243-87 | Bmsqd-2 | *Bombyx mori* |
| 1504 | 2243-91 | sodium/iodide symporter | *Homo sapiens* |
| 1505 | 2243-92 | ORF2 | *Acidianus ambivalens* |
| 1506 | 2243-94 | lysosomal beta-galactosidase | *Felis cattus* |
| 1507 | 2244-12 | tropomyosin isoform 127 | *D. melanogaster* |
| 1508 | 2244-19 | KIAA0181 | *Homo sapiens* |
| 1509 | 2244-23 | plasma membrane calcium ATPase isoform 1 | *Homo sapiens* |
| 1510 | 2244-29 | NADH dehydrogenase | *Bos taurus* |
| 1511 | 2244-44 | glutamate dehydrogenase | *D. melanogaster* |
| 1512 | 2244-54 | spliceosomal protein | *D. melanogaster* |
| 1513 | 2244-59 | ciliary body glutathione peroxidase | *Bos taurus* |
| 1514 | 2244-61 | pyridoxal-phoshate-dependent aminotransferases | *C. elegans* |
| 1515 | 2244-64 | Unknown | *Rattus norvegicus* |
| 1516 | 2244-69 | trypsin-like serine protease | *C. felis* |
| 1517 | 2244-71 | peritrophin 1 | *Anopheles gambiae* |
| 1518 | 2244-75 | NADH dehydrogenase subunit 5 | *Anopheles gambiae* |
| 1519 | 2244-84 | microsomal epoxide hydrolase | *Rattus norvegicus* |
| 1520 | 2244-86 | C54G7.2 gene product | *C. elegans* |
| 1521 | 2244-91 | Aminopeptidase N | *Plutella xylostella* |
| 1522 | 2253-2 | cytochrome C oxidase | *H. sapiens* |
| 1523 | 2253-13 | Initiation factor 5A | *Gallus gallus* |
| 1524 | 2253-14 | protein phosphatase type 2A catalytic subunit | *Bos taurus* |
| 1525 | 2253-16 | myosin light chain 2 | *D. melanogaster* |
| 1526 | 2253-18 | cDNA EST yk462d1.5 | *C. elegans* |
| 1527 | 2253-19 | ribosomal protein S10 | *H. sapiens* |
| 1528 | 2253-24 | aspartyl(asparaginyl)beta-hydroxylase, HAAH | *H. sapiens* |
| 1529 | 2253-27 | larval and adult myosin heavy chain | *D. melanogaster* |
| 1530 | 2253-33 | nervous system antigen 2 | *D. melanogaster* |
| 1531 | 2253-36 | dJ366N23.2 | *H. sapiens* |
| 1532 | 2253-40 | hrp48.1 | *D. melanogaster* |
| 1533 | 2253-42 | ZnT-1 | *Mus musculus* |
| 1534 | 2253-43 | aminopeptidase N | *Manduca sexta* |
| 1535 | 2253-56 | Profilin | *D. melanogaster* |
| 1536 | 2253-59 | T26A5. | *H. sapiens* |
| 1537 | 2253-68 | NADH-ubiquinone oxido-reductase 42 kDa subunit | *D. melanogaster* |
| 1538 | 2253-78 | glycine-rich protein | |
| 1539 | 2253-81 | 5'-nucleotidase | *H. sapiens* |
| 1540 | 2253-86 | glutathione S-transferase | *Anopheles gambiae* |
| 1541 | 2253-87 | ferritin subunit 1 | *D. melanogaster* |
| 1542 | 2253-92 | myosin light chain 2 | *D. melanogaster* |
| 1543 | 2253-94 | xylose-proton symport | *E. coli* |
| 1544 | 2254-4 | mature-parasite-infected erythrocyte surface antigen | *P. falciparum* |
| 1545 | 2254-6 | Fo-ATP synthase subunit b | *D. melanogaster* |
| 1546 | 2254-13 | similar to *Arabidopsis thaliana* male sterility protein 2 | *C. elegans* |
| 1547 | 2254-17 | CLN3 protein | *H. sapiens* |
| 1548 | 2254-21 | YbgG | *B. subtilis* |
| 1549 | 2254-25 | peroxisomal protein | *Synechocystis* sp |
| 1550 | 2254-27 | Glutaminase | *Rattus norvegicus* |
| 1551 | 2254-30 | tartan protein | *D. melanogaster* |
| 1552 | 2254-33 | leucine zipper-EF-hand containing transmembrane protein 1 | *H. sapiens* |
| 1553 | 2254-39 | similar to helicase | *C. elegans* |
| 1554 | 2254-43 | muscle myosin heavy chain | *D. melanogaster* |
| 1555 | 2254-45 | putative nicotinate phosphoribosyltransferase | *N. tabacum* |
| 1556 | 2254-51 | 60S ribosomal protein | *Mus musculus* |
| 1557 | 2254-54 | small nuclear riboprotein Sm-D | *H. sapiens* |
| 1558 | 2254-55 | nucleoside diphosphate kinase | *Salmo salar* |
| 1559 | 2254-60 | serine protease | *C. felis* |
| 1560 | 2254-63 | myospheroid protein | *D. melanogaster* |
| 1561 | 2254-65 | Carboxylesterase | *Anisopteromalus calandrae* |
| 1562 | 2254-66 | siah binding protein 1 | *H. sapiens* |
| 1563 | 2254-70 | vacuolar ATPase, subunit M9.7 | *Manduca sexta* |
| 1564 | 2254-83 | Fumarylacetoacetate hydrolase | *Rattus norvegicus* |
| 1565 | 2254-84 | metalloproteinase 1 | *Hydra vulgaris* |
| 1566 | 2254-88 | alpha-spectrin | *D. melanogaster* |
| 1567 | 2254-93 | NADH dehydrogenase subunit 6 | *D. melanogaster* |
| 1568 | 2254-96 | cyclophilin isoform 5 | *C. elegans* |
| 1569 | 2255-5 | similar to mitochondrial ATPase inhibitors | *C. elegans* |
| 1570 | 2255-8 | yk391f12.5 | *C. elegans* |
| 1571 | 2255-12 | Unknown | *H. sapiens* |
| 1572 | 2255-17 | ribonucleotide reductase subunit M1 | *M. musculus* |
| 1573 | 2255-19 | docking protein | *H. sapiens* |
| 1574 | 2255-22 | Similar to rat 5E5 antigen | *H. sapiens* |
| 1575 | 2255-23 | ribosomal protein S31 | *D. melanogaster* |
| 1576 | 2255-25 | Similar to acyl-CoA dehydrogenase | *C. elegans* |
| 1577 | 2255-28 | Arginine tyrosine kinase | *H. sapiens* |
| 1578 | 2255-32 | ribosomal protein L7a | *D. melanogaster* |
| 1579 | 2255-33 | chS-Rex-s | *G. gallus* |
| 1580 | 2255-39 | Phosphoacetylglucosamine mutase | *C. elegans* |
| 1581 | 2255-41 | NADH dehydrogenase subunit 6 | *D. melanogaster* |
| 1582 | 2255-45 | tRNA-glutamine synthetase | *C. elegans* |
| 1583 | 2255-46 | p68 | *M. musculus* |
| 1584 | 2255-49 | ABC8 | *M. musculus* |
| 1585 | 2255-50 | kynurenine aminotransferase | *R. rattus* |
| 1586 | 2255-51 | SmD homolog {Gly-Arg repeat} | *M. musculus* |
| 1587 | 2255-56 | epoxide hydrolase | *S. scrofa* |
| 1588 | 2255-60 | Sec23 protein | *H. sapiens* |
| 1589 | 2255-62 | HMG CoA synthase | *M. musculus* |
| 1590 | 2255-63 | dipeptidyl aminopeptidase-like protein 6 | *M. musculus* |
| 1591 | 2255-66 | retinal rod Na+/Ca+, K+ exchanger | *H. sapiens* |
| 1592 | 2255-67 | 4-hydroxybutyrate coenzyme A transferase | *C. elegans* |
| 1593 | 2255-70 | hD54+ins2 isoform | *H. sapiens* |
| 1594 | 2255-73 | chromaffin granule ATPase II homolog | *M. musculus* |
| 1595 | 2255-77 | 40S ribosomal protein S10 | *H. sapiens* |
| 1596 | 2255-79 | 34/67 kD laminin binding protein | *S. purpuratus* |
| 1597 | 2255-82 | RNA-binding protein lark | *D. melanogaster* |
| 1598 | 2255-86 | thiol-specific antioxidant protein | *R. norvegicus* |

TABLE II-continued

| SEQ ID NO: | Name | Genbank Homology | Organism |
|---|---|---|---|
| 1599 | 2256-7 | Similar to Human estrogen-responsive finger protein | H. sapiens |
| 1600 | 2256-11 | Trypsin | C. felis |
| 1601 | 2256-12 | CEV14 | H. sapiens |
| 1602 | 2256-16 | AL021475 | C. elegans |
| 1603 | 2256-21 | Heterogenous Nuclear Ribonucleoprotein C1 | H. sapiens |
| 1604 | 2256-22 | b4 integrin interactor | H. sapiens |
| 1605 | 2256-28 | testis enhanced gene transcript protein | H. sapiens |
| 1606 | 2256-31 | synaptic vesicle protein 2B | R. norvegicus |
| 1607 | 2256-40 | TNF-alpha stimulated ABC protein | H. sapiens |
| 1608 | 2256-42 | carboxypeptidase A | H. armigera |
| 1609 | 2256-46 | pherophorin S | V. carteri |
| 1610 | 2256-52 | Fo-ATP synthase subunit b | D. melanogaster |
| 1611 | 2256-54 | PDGF associated protein | H. sapiens |
| 1612 | 2256-58 | S20 ribosomal protein | D. melanogaster |
| 1613 | 2256-64 | ribosomal protein S9 | H. sapiens |
| 1614 | 2256-69 | elongation factor 1 -gamma | Artemia sp |
| 1615 | 2256-70 | conserved hypothetical protein | S. pombe |
| 1616 | 2256-72 | fructose 1,6 bisphosphate-aldolase 4C | D. melanogaster |
| 1617 | 2256-73 | troponin-T | D. melanogaster |
| 1618 | 2256-80 | SRP14 | C. familiaris |
| 1619 | 2256-82 | succinyl-CoA synthetase alpha subunit | S. scrofa |
| 1620 | 2256-89 | Csa-19 | H. sapiens |
| 1621 | 2256-92 | Sacm21 | M. musculus |
| 1622 | 2256-94 | apoptosis inhibitor | Cydia pomonella granulosis virus |
| 1623 | 2256-96 | ribosomal protein L22 | D. melanogaster |

Table III represents a variety of flea HNC nucleic acid molecules of the present invention.

TABLE III

| SEQ ID NO: | Name |
|---|---|
| 567 | 2096-19NB.HNC |
| 568 | 2096-25NB.HNC |
| 569 | 2096-48NB.HNC |
| 570 | 2096-50NB.HNC |
| 571 | 2096-52NB.HNC |
| 572 | 2096-55NB.HNC |
| 573 | 2097-09NB.HNC |
| 574 | 2097-15NB.HNC |
| 575 | 2097-20NB.HNC |
| 576 | 2097-22NB.HNC |
| 577 | 2097-32NB.HNC |
| 578 | 2097-45NB.HNC |
| 579 | 2097-46NB.HNC |
| 580 | 2097-47NB.HNC |
| 581 | 2097-56NB.HNC |
| 582 | 2097-64NB.HNC |
| 583 | 2098-04NB.HNC |
| 584 | 2098-40NB.HNC |
| 585 | 2098-43NB.HNC |
| 586 | 2099-9NB.HNC |
| 587 | 2100-10NB.HNC |
| 588 | 2100-45NB.HNC |
| 589 | 2100-47NB.HNC |
| 590 | 2100-56NB.HNC |
| 591 | 2100-63NB.HNC |
| 592 | 2110-41NB.HNC |
| 593 | 2110-53NB.HNC |
| 594 | 2112-12NB.HNC |
| 595 | 2112-35NB.HNC |
| 596 | 2113-17NB.HNC |
| 597 | 2115-16NB.HNC |
| 598 | 2115-22NB.HNC |
| 599 | 2115-3NB.HNC |
| 600 | 2116-19NB.HNC |
| 601 | 2116-24NB.HNC |
| 602 | 2116-27NB.HNC |
| 603 | 2116-41NB.HNC |
| 604 | 2116-59NB.HNC |
| 605 | 2116-64NB.HNC |
| 606 | 2117-05NB.HNC |
| 607 | 2117-09NB.HNC |
| 608 | 2117-11NB.HNC |
| 609 | 2117-53NB.HNC |
| 610 | 2118-03NB.HNC |
| 611 | 2122-39NB.HNC |
| 612 | 2123-25NB.HNC |
| 613 | 2124-40NB.HNC |
| 614 | 2124-62NB.HNC |
| 615 | 2131-22NB.HNC |
| 616 | 2131-32NB.HNC |
| 617 | 2132-15NB.HNC |
| 618 | 2132-28NB.HNC |
| 619 | 2132-63NB.HNC |
| 620 | 2132-9NB.HNC |
| 621 | 2137-19NB.HNC |
| 622 | 2137-24NB.HNC |
| 623 | 2138-05NB.HNC |
| 624 | 2138-51NB.HNC |
| 625 | 2139-31NB.HNC |
| 626 | 2139-41NB.HNC |
| 627 | 2139-60NB.HNC |
| 628 | 2140-13NB.HNC |
| 629 | 2140-15NB.HNC |
| 630 | 2140-18NB.HNC |
| 631 | 2140-54NB.HNC |
| 632 | 2141-16NB.HNC |
| 633 | 2141-59NB.HNC |
| 634 | 2142-16NB.HNC |
| 635 | 2142-18NB.HNC |
| 636 | 2143-06NB.HNC |
| 637 | 2143-07NB.HNC |
| 638 | 2143-33NB.HNC |
| 639 | 2143-54NB.HNC |
| 640 | 2168-06NB.HNC |
| 641 | 2168-09NB.HNC |
| 642 | 2168-42NB.HNC |
| 643 | 2168-79NB.HNC |
| 644 | 2168-82NB.HNC |
| 645 | 2170-04NB.HNC |
| 646 | 2170-08NB.HNC |
| 647 | 2170-82NB.HNC |
| 648 | 2172-39NB.HNC |
| 649 | 2172-59NB.HNC |
| 650 | 2172-60NB.HNC |
| 651 | 2172-77NB.HNC |
| 652 | 2174-14NB.HNC |
| 653 | 2174-17NB.HNC |
| 654 | 2174-41NB.HNC |
| 655 | 2174-49NB.HNC |
| 656 | 2174-59NB.HNC |
| 657 | 2174-68NB.HNC |
| 658 | 2176-21NB.HNC |
| 659 | 2176-34NB.HNC |
| 660 | 2176-47NB.HNC |
| 661 | 2176-56NB.HNC |
| 662 | 2176-62NB.HNC |
| 663 | 2176-63NB.HNC |
| 664 | 2176-64NB.HNC |
| 665 | 2176-65NB.HNC |
| 666 | 2176-75NB.HNC |
| 667 | 2178-05NB.HNC |
| 668 | 2178-13NB.HNC |
| 669 | 2178-23NB.HNC |
| 670 | 2178-25NB.HNC |
| 671 | 2178-41NB.HNC |
| 672 | 2178-56NB.HNC |
| 673 | 2178-57NB.HNC |
| 674 | 2178-58NB.HNC |
| 675 | 2178-67NB.HNC |
| 676 | 2178-72NB.HNC |

TABLE III-continued

| SEQ ID NO: | Name |
|---|---|
| 677 | 2178-78NB.HNC |
| 678 | 2178-80NB.HNC |
| 679 | 2178-90NB.HNC |
| 680 | 2178-91NB.HNC |
| 681 | 2178-95NB.HNC |
| 682 | 2180-05NB.HNC |
| 683 | 2180-18NB.HNC |
| 684 | 2180-20NB.HNC |
| 685 | 2180-32NB.HNC |
| 686 | 2180-59NB.HNC |
| 687 | 2180-62NB.HNC |
| 688 | 2180-74NB.HNC |
| 689 | 2180-78NB.HNC |
| 690 | 2180-79NB.HNC |
| 691 | 2180-88NB.HNC |
| 692 | 2180-90NB.HNC |
| 693 | 2182-07NB.HNC |
| 694 | 2182-12NB.HNC |
| 695 | 2182-13NB.HNC |
| 696 | 2182-27NB.HNC |
| 697 | 2182-2NB.HNC |
| 698 | 2182-46NB.HNC |
| 699 | 2182-55NB.HNC |
| 700 | 2182-57NB.HNC |
| 701 | 2182-63NB.HNC |
| 702 | 2182-64NB.HNC |
| 703 | 2182-83NB.HNC |
| 704 | 2182-86NB.HNC |
| 705 | 2182-88NB.HNC |
| 706 | 2182-90NB.HNC |
| 707 | 2182-92NB.HNC |
| 708 | 2182-94NB.HNC |
| 709 | 2184-15NB.HNC |
| 710 | 2184-37NB.HNC |
| 711 | 2184-65NB.HNC |
| 712 | 2186-14NB.HNC |
| 713 | 2186-45NB.HNC |
| 714 | 2186-50NB.HNC |
| 715 | 2186-52NB.HNC |
| 716 | 2186-60NB.HNC |
| 717 | 2186-62NB.HNC |
| 718 | 2186-63NB.HNC |
| 719 | 2186-68NB.HNC |
| 720 | 2186-69NB.HNC |
| 721 | 2211-19NB.HNC |
| 722 | 2211-23NB.HNC |
| 723 | 2211-29NB.HNC |
| 724 | 2211-30NB.HNC |
| 725 | 2211-43NB.HNC |
| 726 | 2211-52NB.HNC |
| 727 | 2211-64NB.HNC |
| 728 | 2212-30NB.HNC |
| 729 | 2212-31NB.HNC |
| 730 | 2212-71NB.HNC |
| 731 | 2212-72NB.HNC |
| 732 | 2212-73NB.HNC |
| 733 | 2212-81NB.HNC |
| 734 | 2212-85NB.HNC |
| 735 | 2212-87NB.HNC |
| 736 | 2212-91NB.HNC |
| 737 | 2212-96NB.HNC |
| 738 | 2212-9NB.HNC |
| 739 | 2213-08NB.HNC |
| 740 | 2213-09NB.HNC |
| 741 | 2213-11NB.HNC |
| 742 | 2213-12NB.HNC |
| 743 | 2213-18NB.HNC |
| 744 | 2213-34NB.HNC |
| 745 | 2213-53NB.HNC |
| 746 | 2213-58NB.HNC |
| 747 | 2213-67NB.HNC |
| 748 | 2213-79NB.HNC |
| 749 | 2214-02NB.HNC |
| 750 | 2214-03NB.HNC |
| 751 | 2214-05NB.HNC |
| 752 | 2214-07NB.HNC |
| 753 | 2214-15NB.HNC |
| 754 | 2214-23NB.HNC |
| 755 | 2214-30NB.HNC |
| 756 | 2214-36NB.HNC |
| 757 | 2214-37NB.HNC |
| 758 | 2214-40NB.HNC |
| 759 | 2214-43NB.HNC |
| 760 | 2214-53NB.HNC |
| 761 | 2214-57NB.HNC |
| 762 | 2214-60NB.HNC |
| 763 | 2214-61NB.HNC |
| 764 | 2214-73NB.HNC |
| 765 | 2214-76NB.HNC |
| 766 | 2214-80NB.HNC |
| 767 | 2215-07NB.HNC |
| 768 | 2215-15NB.HNC |
| 769 | 2215-31NB.HNC |
| 770 | 2215-41NB.HNC |
| 771 | 2215-51NB.HNC |
| 772 | 2215-80NB.HNC |
| 773 | 2215-85NB.HNC |
| 774 | 2215-91NB.HNC |
| 775 | 2217-14NB.HNC |
| 776 | 2217-16NB.HNC |
| 777 | 2217-33NB.HNC |
| 778 | 2217-39NB.HNC |
| 779 | 2217-78NB.HNC |
| 780 | 2217-92NB.HNC |
| 781 | 2218-15NB.HNC |
| 782 | 2218-19NB.HNC |
| 783 | 2218-26NB.HNC |
| 784 | 2218-36NB.HNC |
| 785 | 2218-41NB.HNC |
| 786 | 2218-56NB.HNC |
| 787 | 2218-58NB.HNC |
| 788 | 2218-69NB.HNC |
| 789 | 2218-71NB.HNC |
| 790 | 2218-76NB.HNC |
| 791 | 2218-77NB.HNC |
| 792 | 2218-84NB.HNC |
| 793 | 2218-96NB.HNC |
| 794 | 2219-11NB.HNC |
| 795 | 2219-13NB.HNC |
| 796 | 2219-17NB.HNC |
| 797 | 2219-19NB.HNC |
| 798 | 2219-20NB.HNC |
| 799 | 2219-22NB.HNC |
| 800 | 2219-23NB.HNC |
| 801 | 2219-32NB.HNC |
| 802 | 2219-45NB.HNC |
| 803 | 2219-49NB.HNC |
| 804 | 2219-51NB.HNC |
| 805 | 2219-72NB.HNC |
| 806 | 2219-80NB.HNC |
| 807 | 2219-952122-39NB.HNC 2220-02NB.HNC |
| 808 | 2220-02NB.HNC |
| 809 | 2220-27NB.HNC |
| 810 | 2220-32NB.HNC |
| 811 | 2220-53NB.HNC |
| 812 | 2220-60NB.HNC |
| 813 | 2220-66NB.HNC |
| 814 | 2221-06NB.HNC |
| 815 | 2221-15NB.HNC |
| 816 | 2221-18NB.HNC |
| 817 | 2221-20NB.HNC |
| 818 | 2221-24NB.HNC |
| 819 | 2221-45NB.HNC |
| 820 | 2221-46NB.HNC |
| 821 | 2221-48NB.HNC |
| 822 | 2221-54NB.HNC |
| 823 | 2221-55NB.HNC |
| 824 | 2221-59NB.HNC |
| 825 | 2221-61NB.HNC |
| 826 | 2221-62NB.HNC |
| 827 | 2221-70NB.HNC |
| 828 | 2221-86NB.HNC |
| 829 | 2221-87NB.HNC |

TABLE III-continued

| SEQ ID NO: | Name |
|---|---|
| 830 | 2221-95NB.HNC |
| 831 | 2223u-18NB.HNC |
| 832 | 2223u-22NB.HNC |
| 833 | 2223u-23NB.HNC |
| 834 | 2223u-31NB.HNC |
| 835 | 2223u-33NB.HNC |
| 836 | 2223u-36NB.HNC |
| 837 | 2223u-67NB.HNC |
| 838 | 2223u-85NB.HNC |
| 839 | 2224u-05NB.HNC |
| 840 | 2224u-07NB.HNC |
| 841 | 2224u-10NB.HNC |
| 842 | 2224u-11NB.HNC |
| 843 | 2224u-15NB.HNC |
| 844 | 2224u-25NB.HNC |
| 845 | 2224u-27NB.HNC |
| 846 | 2224u-44NB.HNC |
| 847 | 2224u-52NB.HNC |
| 848 | 2224u-62NB.HNC |
| 849 | 2224u-70NB.HNC |
| 850 | 2224u-71NB.HNC |
| 851 | 2224u-79NB.HNC |
| 852 | 2225u-11NB.HNC |
| 853 | 2225u-20NB.HNC |
| 854 | 2225u-23NB.HNC |
| 855 | 2225u-28NB.HNC |
| 856 | 2225u-55NB.HNC |
| 857 | 2225u-59NB.HNC |
| 858 | 2225u-64NB.HNC |
| 859 | 2225u-77NB.HNC |
| 860 | 2225u-95NB.HNC |
| 861 | 2226-932122-39NB.HNC |
| 862 | 2226u-07NB.HNC |
| 863 | 2226u-19NB.HNC |
| 864 | 2226u-39NB.HNC |
| 865 | 2226u-45NB.HNC |
| 866 | 2226u-49NB.HNC |
| 867 | 2226u-54NB.HNC |
| 868 | 2226u-71NB.HNC |
| 869 | 2226u-77NB.HNC |
| 870 | 2226u-83NB.HNC |
| 871 | 2226u-91NB.HNC |
| 872 | 2227u-12NB.HNC |
| 873 | 2227u-13NB.HNC |
| 874 | 2227u-23NB.HNC |
| 875 | 2227u-26NB.HNC |
| 876 | 2227u-30NB.HNC |
| 877 | 2227u-31NB.HNC |
| 878 | 2227u-33NB.HNC |
| 879 | 2227u-43NB.HNC |
| 880 | 2227u-51NB.HNC |
| 881 | 2227u-60NB.HNC |
| 882 | 2227u-93NB.HNC |
| 883 | 2228u-04NB.HNC |
| 884 | 2228u-09NB.HNC |
| 885 | 2228u-12NB.HNC |
| 886 | 2228u-21NB.HNC |
| 887 | 2228u-26NB.HNC |
| 888 | 2228u-49NB.HNC |
| 889 | 2228u-54NB.HNC |
| 890 | 2228u-55NB.HNC |
| 891 | 2228u-61NB.HNC |
| 892 | 2228u-65NB.HNC |
| 893 | 2228u-79NB.HNC |
| 894 | 2228u-90NB.HNC |
| 1624 | 2222-7 |
| 1625 | 2222-16 |
| 1626 | 2222-19 |
| 1627 | 2222-39 |
| 1628 | 2222-56 |
| 1629 | 2222-59 |
| 1630 | 2222-79 |
| 1631 | 2222-89 |
| 1632 | 2228-4 |
| 1633 | 2228-9 |
| 1634 | 2228-12 |
| 1635 | 2228-21 |
| 1636 | 2228-26 |
| 1637 | 2228-49 |
| 1638 | 2228-54 |
| 1639 | 2228-61 |
| 1640 | 2228-65 |
| 1641 | 2228-79 |
| 1642 | 2228-90 |
| 1643 | 2245-5 |
| 1644 | 2245-7 |
| 1645 | 2245-15 |
| 1646 | 2245-16 |
| 1647 | 2245-17 |
| 1648 | 2245-20 |
| 1649 | 2245-35 |
| 1650 | 2245-38 |
| 1651 | 2245-39 |
| 1652 | 2245-51 |
| 1653 | 2245-52 |
| 1654 | 2245-57 |
| 1655 | 2246-13 |
| 1656 | 2246-19 |
| 1657 | 2246-25 |
| 1658 | 2246-27 |
| 1659 | 2246-29 |
| 1660 | 2246-40 |
| 1661 | 2246-45 |
| 1662 | 2246-52 |
| 1663 | 2246-64 |
| 1664 | 2246-66 |
| 1665 | 2246-74 |
| 1666 | 2246-82 |
| 1667 | 2247-6 |
| 1668 | 2247-17 |
| 1669 | 2247-29 |
| 1670 | 2247-31 |
| 1671 | 2247-36 |
| 1672 | 2247-40 |
| 1673 | 2247-46 |
| 1674 | 2247-50 |
| 1675 | 2247-54 |
| 1676 | 2247-63 |
| 1677 | 2247-66 |
| 1678 | 2247-68 |
| 1679 | 2247-69 |
| 1680 | 2247-81 |
| 1681 | 2247-82 |
| 1682 | 2247-95 |
| 1683 | 2248-7 |
| 1684 | 2248-18 |
| 1685 | 2248-32 |
| 1686 | 2248-41 |
| 1687 | 2248-50 |
| 1688 | 2248-54 |
| 1689 | 2248-60 |
| 1690 | 2248-62 |
| 1691 | 2248-65 |
| 1692 | 2248-86 |
| 1693 | 2248-94 |
| 1694 | 2249-6 |
| 1695 | 2249-30 |
| 1696 | 2249-35 |
| 1697 | 2249-36 |
| 1698 | 2249-68 |
| 1699 | 2249-74 |
| 1700 | 2249-79 |
| 1701 | 2250-20 |
| 1702 | 2250-24 |
| 1703 | 2251-7 |
| 1704 | 2251-21 |
| 1705 | 2251-25 |
| 1706 | 2251-38 |
| 1707 | 2251-58 |
| 1708 | 2252-7 |
| 1709 | 2252-15 |
| 1710 | 2252-19 |
| 1711 | 2252-24 |
| 1712 | 2252-26 |

TABLE III-continued

| SEQ ID NO: | Name |
|---|---|
| 1713 | 2252-27 |
| 1714 | 2252-32 |
| 1715 | 2252-36 |
| 1716 | 2252-37 |
| 1717 | 2252-69 |
| 1718 | 2252-78 |

Table IV represents a variety of flea HMT nucleic acid molecules of the present invention.

TABLE IV

| SEQ ID NO: | Name |
|---|---|
| 895 | 2084-02.HMTNB |
| 896 | 2084-05.HMTNB |
| 897 | 2084-07.HMTNB |
| 898 | 2084-09.HMTNB |
| 899 | 2084-15.HMTNB |
| 900 | 2084-17.HMTNB |
| 901 | 2084-18.HMTNB |
| 902 | 2084-21.HMTNB |
| 903 | 2084-22.HMTNB |
| 904 | 2084-30.HMTNB |
| 905 | 2084-33.HMTNB |
| 906 | 2084-36.HMTNB |
| 907 | 2084-37.HMTNB |
| 908 | 2084-38.HMTNB |
| 909 | 2084-39.HMTNB |
| 910 | 2084-43.HMTNB |
| 911 | 2084-50.HMTNB |
| 912 | 2084-54.HMTNB |
| 913 | 2084-56.HMTNB |
| 914 | 2084-59.HMTNB |
| 915 | 2085-03.HMTNB |
| 916 | 2085-13.HMTNB |
| 917 | 2085-35.HMTNB |
| 918 | 2085-38.HMTNB |
| 919 | 2085-39.HMTNB |
| 920 | 2085-49.HMTNB |
| 921 | 2085-53.HMTNB |
| 922 | 2085-58.HMTNB |
| 923 | 2085-61.HMTNB |
| 924 | 2086-05.HMTNB |
| 925 | 2086-10.HMTNB |
| 926 | 2086-13.HMTNB |
| 927 | 2086-15.HMTNB |
| 928 | 2086-20.HMTNB |
| 929 | 2086-25.HMTNB |
| 930 | 2086-32.HMTNB |
| 931 | 2086-33.HMTNB |
| 932 | 2086-34.HMTNB |
| 933 | 2086-37.HMTNB |
| 934 | 2086-41.HMTNB |
| 935 | 2086-43.HMTNB |
| 936 | 2086-44.HMTNB |
| 937 | 2086-54.HMTNB |
| 938 | 2086-55.HMTNB |
| 939 | 2086-58.HMTNB |
| 940 | 2087-09.HMTNB |
| 941 | 2087-17.HMTNB |
| 942 | 2087-28.HMTNB |
| 943 | 2087-33.HMTNB |
| 944 | 2087-35.HMTNB |
| 945 | 2087-51.HMTNB |
| 946 | 2087-54.HMTNB |
| 947 | 2088-07.HMTNB |
| 948 | 2088-17.HMTNB |
| 949 | 2088-35.HMTNB |
| 950 | 2088-52.HMTNB |
| 951 | 2088-59.HMTNB |
| 952 | 2089-12.HMTNB |
| 953 | 2089-14.HMTNB |
| 954 | 2089-33.HMTNB |
| 955 | 2089-36.HMTNB |

TABLE IV-continued

| SEQ ID NO: | Name |
|---|---|
| 956 | 2089-51.HMTNB |
| 957 | 2089-60.HMTNB |
| 958 | 2090-11.HMTNB |
| 959 | 2090-27.HMTNB |
| 960 | 2090-33.HMTNB |
| 961 | 2090-44.HMTNB |
| 962 | 2090-57.HMTNB |
| 963 | 2091-11.HMTNB |
| 964 | 2091-22.HMTNB |
| 965 | 2091-23.HMTNB |
| 966 | 2091-35.HMTNB |
| 967 | 2091-63.HMTNB |
| 968 | 2092-11.HMTNB |
| 969 | 2092-16.HMTNB |
| 970 | 2092-40.HMTNB |
| 971 | 2092-42.HMTNB |
| 972 | 2092-46.HMTNB |
| 973 | 2092-60.HMTNB |
| 974 | 2093-20.HMTNB |
| 975 | 2093-23.HMTNB |
| 976 | 2093-43.HMTNB |
| 977 | 2093-48.HMTNB |
| 978 | 2093-50.HMTNB |
| 979 | 2093-62.HMTNB |
| 980 | 2093-63.HMTNB |
| 981 | 2094-08.HMTNB |
| 982 | 2094-26.HMTNB |
| 983 | 2094-33.HMTNB |
| 984 | 2094-47.HMTNB |
| 985 | 2094-50.HMTNB |
| 986 | 2094-62.HMTNB |
| 987 | 2095-04.HMTNB |
| 988 | 2095-10.HMTNB |
| 989 | 2095-12.HMTNB |
| 990 | 2095-13.HMTNB |
| 991 | 2095-15.HMTNB |
| 992 | 2095-20.HMTNB |
| 993 | 2095-22.HMTNB |
| 994 | 2095-31.HMTNB |
| 995 | 2095-33.HMTNB |
| 996 | 2095-34.HMTNB |
| 997 | 2095-36.HMTNB |
| 998 | 2095-40.HMTNB |
| 999 | 2095-48.HMTNB |
| 1000 | 2102-12.HMTNB |
| 1001 | 2102-16.HMTNB |
| 1002 | 2102-18.HMTNB |
| 1003 | 2102-19.HMTNB |
| 1004 | 2102-20.HMTNB |
| 1005 | 2102-29.HMTNB |
| 1006 | 2102-35.HMTNB |
| 1007 | 2102-37.HMTNB |
| 1008 | 2102-38.HMTNB |
| 1009 | 2102-41.HMTNB |
| 1010 | 2102-47.HMTNB |
| 1011 | 2103-02.HMTNB |
| 1012 | 2103-09.HMTNB |
| 1013 | 2103-45.HMTNB |
| 1014 | 2103-56.HMTNB |
| 1015 | 2103-58.HMTNB |
| 1016 | 2104-58.HMTNB |
| 1017 | 2104-60.HMTNB |
| 1018 | 2104-61.HMTNB |
| 1019 | 2105-02.HMTNB |
| 1020 | 2105-20.HMTNB |
| 1021 | 2105-35.HMTNB |
| 1022 | 2105-42.HMTNB |
| 1023 | 2105-44.HMTNB |
| 1024 | 2106-05.HMTNB |
| 1025 | 2106-27.HMTNB |
| 1026 | 2106-29.HMTNB |
| 1027 | 2106-34.HMTNB |
| 1028 | 2106-48.HMTNB |
| 1029 | 2106-50.HMTNB |
| 1030 | 2106-64.HMTNB |
| 1031 | 2107-02.HMTNB |
| 1032 | 2107-10.HMTNB |

TABLE IV-continued

| SEQ ID NO: | Name |
|---|---|
| 1033 | 2107-37.HMTNB |
| 1034 | 2108-03.HMTNB |
| 1035 | 2108-23.HMTNB |
| 1036 | 2108-46.HMTNB |
| 1037 | 2108-47.HMTNB |
| 1038 | 2108-48.HMTNB |
| 1039 | 2108-49.HMTNB |
| 1040 | 2108-63.HMTNB |
| 1041 | 2109-04.HMTNB |
| 1042 | 2109-06.HMTNB |
| 1043 | 2109-37.HMTNB |
| 1044 | 2109-38.HMTNB |
| 1045 | 2109-44.HMTNB |
| 1046 | 2154-08.HMTNB |
| 1047 | 2154-09.HMTNB |
| 1048 | 2154-10.HMTNB |
| 1049 | 2154-28.HMTNB |
| 1050 | 2154-30.HMTNB |
| 1051 | 2154-45.HMTNB |
| 1052 | 2154-46.HMTNB |
| 1053 | 2154-61.HMTNB |
| 1054 | 2154-71.HMTNB |
| 1055 | 2154-81.HMTNB |
| 1056 | 2154-83.HMTNB |
| 1057 | 2156-02.HMTNB |
| 1058 | 2156-06.HMTNB |
| 1059 | 2156-18.HMTNB |
| 1060 | 2156-27.HMTNB |
| 1061 | 2156-43.HMTNB |
| 1062 | 2156-48.HMTNB |
| 1063 | 2156-50.HMTNB |
| 1064 | 2157-16.HMTNB |
| 1065 | 2157-34.HMTNB |
| 1066 | 2157-45.HMTNB |
| 1067 | 2157-70.HMTNB |
| 1068 | 2157-75.HMTNB |
| 1069 | 2157-79.HMTNB |
| 1070 | 2157-86.HMTNB |
| 1071 | 2158-02.HMTNB |
| 1072 | 2158-14.HMTNB |
| 1073 | 2158-19.HMTNB |
| 1074 | 2158-22.HMTNB |
| 1075 | 2158-27.HMTNB |
| 1076 | 2158-34.HMTNB |
| 1077 | 2158-37.HMTNB |
| 1078 | 2158-39.HMTNB |
| 1079 | 2159-07.HMTNB |
| 1080 | 2159-09.HMTNB |
| 1081 | 2159-17.HMTNB |
| 1082 | 2159-34.HMTNB |
| 1083 | 2159-35.HMTNB |
| 1084 | 2159-60.HMTNB |
| 1085 | 2160-16.HMTNB |
| 1086 | 2160-17.HMTNB |
| 1087 | 2160-29.HMTNB |
| 1088 | 2160-30.HMTNB |
| 1089 | 2160-32.HMTNB |
| 1090 | 2160-39.HMTNB |
| 1091 | 2160-49.HMTNB |
| 1092 | 2160-53.HMTNB |
| 1093 | 2160-54.HMTNB |
| 1094 | 2160-55.HMTNB |
| 1095 | 2160-77.HMTNB |
| 1096 | 2160-82.HMTNB |
| 1097 | 2160-89.HMTNB |
| 1098 | 2160-91.HMTNB |
| 1099 | 2161-13.HMTNB |
| 1100 | 2161-19.HMTNB |
| 1101 | 2161-45.HMTNB |
| 1102 | 2161-57.HMTNB |
| 1103 | 2161-60.HMTNB |
| 1104 | 2161-79.HMTNB |
| 1105 | 2161-83.HMTNB |
| 1106 | 2161-90.HMTNB |
| 1107 | 2161-94.HMTNB |
| 1108 | 2162-05.HMTNB |
| 1109 | 2162-12.HMTNB |
| 1110 | 2162-13.HMTNB |
| 1111 | 2162-18.HMTNB |
| 1112 | 2162-35.HMTNB |
| 1113 | 2162-41.HMTNB |
| 1114 | 2162-50.HMTNB |
| 1115 | 2162-59.HMTNB |
| 1116 | 2162-63.HMTNB |
| 1117 | 2162-71.HMTNB |
| 1118 | 2162-75.HMTNB |
| 1119 | 2162-78.HMTNB |
| 1120 | 2163-07.HMTNB |
| 1121 | 2163-11.HMTNB |
| 1122 | 2163-18.HMTNB |
| 1123 | 2163-23.HMTNB |
| 1124 | 2163-25.HMTNB |
| 1125 | 2163-43.HMTNB |
| 1126 | 2163-50.HMTNB |
| 1127 | 2163-61.HMTNB |
| 1128 | 2163-65.HMTNB |
| 1129 | 2163-73.HMTNB |
| 1130 | 2163-77.HMTNB |
| 1131 | 2163-87.HMTNB |
| 1132 | 2163-93.HMTNB |
| 1133 | 2163-95.HMTNB |
| 1134 | 2165-04.HMTNB |
| 1135 | 2165-06.HMTNB |
| 1136 | 2165-24.HMTNB |
| 1137 | 2165-45.HMTNB |
| 1138 | 2165-59.HMTNB |
| 1139 | 2165-65.HMTNB |
| 1140 | 2166-02.HMTNB |
| 1141 | 2166-12.HMTNB |
| 1142 | 2166-42.HMTNB |
| 1143 | 2166-46.HMTNB |
| 1144 | 2166-47.HMTNB |
| 1145 | 2167-07.HMTNB |
| 1146 | 2167-16.HMTNB |
| 1147 | 2167-42.HMTNB |
| 1148 | 2167-65.HMTNB |
| 1149 | 2167-66.HMTNB |
| 1150 | 2167-79.HMTNB |
| 1151 | 2167-90.HMTNB |
| 1152 | 2167-94.HMTNB |
| 1153 | 2169-05.HMTNB |
| 1154 | 2169-12.HMTNB |
| 1155 | 2169-16.HMTNB |
| 1156 | 2169-17.HMTNB |
| 1157 | 2169-19.HMTNB |
| 1158 | 2169-22.HMTNB |
| 1159 | 2169-26.HMTNB |
| 1160 | 2169-33.HMTNB |
| 1161 | 2169-42.HMTNB |
| 1162 | 2169-46.HMTNB |
| 1163 | 2169-47.HMTNB |
| 1164 | 2169-57.HMTNB |
| 1165 | 2169-69.HMTNB |
| 1166 | 2171-06.HMTNB |
| 1167 | 2171-09.HMTNB |
| 1168 | 2171-11.HMTNB |
| 1169 | 2171-29.HMTNB |
| 1170 | 2171-33.HMTNB |
| 1171 | 2171-35.HMTNB |
| 1172 | 2171-41.HMTNB |
| 1173 | 2171-54.HMTNB |
| 1174 | 2171-57.HMTNB |
| 1175 | 2171-69.HMTNB |
| 1176 | 2171-82.HMTNB |
| 1177 | 2171-84.HMTNB |
| 1178 | 2171-85.HMTNB |
| 1179 | 2173-12.HMTNB |
| 1180 | 2173-34.HMTNB |
| 1181 | 2173-42.HMTNB |
| 1182 | 2173-48.HMTNB |
| 1183 | 2173-54.HMTNB |
| 1184 | 2173-57.HMTNB |
| 1185 | 2173-75.HMTNB |
| 1186 | 2173-86.HMTNB |

TABLE IV-continued

| SEQ ID NO: | Name |
|---|---|
| 1187 | 2173-91.HMTNB |
| 1188 | 2175-06.HMTNB |
| 1189 | 2175-15.HMTNB |
| 1190 | 2175-20.HMTNB |
| 1191 | 2175-58.HMTNB |
| 1192 | 2175-96.HMTNB |
| 1193 | 2177-16.HMTNB |
| 1194 | 2177-70.HMTNB |
| 1195 | 2177-86.HMTNB |
| 1196 | 2179-02.HMTNB |
| 1197 | 2179-03.HMTNB |
| 1198 | 2179-19.HMTNB |
| 1199 | 2179-22.HMTNB |
| 1200 | 2179-29.HMTNB |
| 1201 | 2179-39.HMTNB |
| 1202 | 2179-63.HMTNB |
| 1203 | 2181-04.HMTNB |
| 1204 | 2181-24.HMTNB |
| 1205 | 2181-35.HMTNB |
| 1206 | 2181-66.HMTNB |
| 1207 | 2181-75.HMTNB |
| 1208 | 2181-76.HMTNB |
| 1209 | 2181-84.HMTNB |
| 1210 | 2183-05.HMTNB |
| 1211 | 2183-13.HMTNB |
| 1212 | 2183-17.HMTNB |
| 1213 | 2183-28.HMTNB |
| 1214 | 2183-45.HMTNB |
| 1215 | 2183-50.HMTNB |
| 1216 | 2183-51.HMTNB |
| 1217 | 2183-70.HMTNB |
| 1218 | 2185-05.HMTNB |
| 1219 | 2185-10.HMTNB |
| 1220 | 2185-12.HMTNB |
| 1221 | 2185-18.HMTNB |
| 1222 | 2185-43.HMTNB |
| 1223 | 2185-49.HMTNB |
| 1224 | 2185-54.HMTNB |
| 1225 | 2185-82.HMTNB |
| 1226 | 2187-21.HMTNB |
| 1227 | 2187-37.HMTNB |
| 1228 | 2187-47.HMTNB |
| 1229 | 2187-93.HMTNB |
| 1230 | 2188-22.HMTNB |
| 1231 | 2188-29.HMTNB |
| 1232 | 2188-32.HMTNB |
| 1233 | 2188-52.HMTNB |
| 1234 | 2188-54.HMTNB |
| 1235 | 2188-72.HMTNB |
| 1236 | 2188-92.HMTNB |
| 1237 | 2189-31.HMTNB |
| 1238 | 2189-56.HMTNB |
| 1239 | 2189-75.HMTNB |
| 1240 | 2189-84.HMTNB |
| 1241 | 2191-23.HMTNB |
| 1242 | 2191-38.HMTNB |
| 1243 | 2191-58.HMTNB |
| 1244 | 2191-73.HMTNB |
| 1245 | 2191-77.HMTNB |
| 1246 | 2191-90.HMTNB |
| 1247 | 2191-94.HMTNB |
| 1248 | 2191-96.HMTNB |
| 1249 | 2192-03.HMTNB |
| 1250 | 2192-14.HMTNB |
| 1251 | 2192-36.HMTNB |
| 1252 | 2192-46.HMTNB |
| 1253 | 2192-88.HMTNB |
| 1254 | 2194-07.HMTNB |
| 1255 | 2194-13.HMTNB |
| 1256 | 2194-16.HMTNB |
| 1257 | 2194-18.HMTNB |
| 1258 | 2194-28.HMTNB |
| 1259 | 2195-06.HMTNB |
| 1260 | 2195-47.HMTNB |
| 1261 | 2195-60.HMTNB |
| 1262 | 2196-18.HMTNB |
| 1263 | 2196-30.HMTNB |
| 1264 | 2196-53.HMTNB |
| 1265 | 2196-65.HMTNB |
| 1266 | 2196-76.HMTNB |
| 1267 | 2197-28.HMTNB |
| 1268 | 2197-46.HMTNB |
| 1269 | 2197-51.HMTNB |
| 1270 | 2197-59.HMTNB |
| 1271 | 2202-96.HMTNB |
| 1272 | 2203-36.HMTNB |
| 1273 | 2204-09.HMTNB |
| 1274 | 2205-11.HMTNB |
| 1275 | 2205-33.HMTNB |
| 1276 | 2205-43.HMTNB |
| 1277 | 2205-85.HMTNB |
| 1278 | 2229-08u.HMTNB |
| 1279 | 2229-10u.HMTNB |
| 1280 | 2229-12u.HMTNB |
| 1281 | 2229-14u.HMTNB |
| 1282 | 2229-27u.HMTNB |
| 1283 | 2229-40u.HMTNB |
| 1284 | 2229-45u.HMTNB |
| 1285 | 2229-48u.HMTNB |
| 1286 | 2229-50u.HMTNB |
| 1287 | 2229-54u.HMTNB |
| 1288 | 2229-56u.HMTNB |
| 1289 | 2229-57u.HMTNB |
| 1290 | 2229-59u.HMTNB |
| 1291 | 2229-70u.HMTNB |
| 1292 | 2229-87u.HMTNB |
| 1293 | 2229-91u.HMTNB |
| 1294 | 2229-95u.HMTNB |
| 1295 | 2230-07u.HMTNB |
| 1296 | 2230-11u.HMTNB |
| 1297 | 2230-19u.HMTNB |
| 1298 | 2230-27u.HMTNB |
| 1299 | 2230-33u.HMTNB |
| 1300 | 2230-41u.HMTNB |
| 1301 | 2230-51u.HMTNB |
| 1302 | 2230-56u.HMTNB |
| 1303 | 2230-66u.HMTNB |
| 1304 | 2230-71u.HMTNB |
| 1305 | 2230-75.HMTNB |
| 1306 | 2230-81u.HMTNB |
| 1307 | 2230-84u.HMTNB |
| 1308 | 2230-93u.HMTNB |
| 1309 | 2231-23u.HMTNB |
| 1310 | 2231-26u.HMTNB |
| 1311 | 2231-32u.HMTNB |
| 1312 | 2231-37u.HMTNB |
| 1313 | 2231-44u.HMTNB |
| 1314 | 2231-50u.HMTNB |
| 1315 | 2231-51u.HMTNB |
| 1316 | 2231-63u.HMTNB |
| 1317 | 2231-68u.HMTNB |
| 1318 | 2231-74u.HMTNB |
| 1319 | 2231-82u.HMTNB |
| 1320 | 2231-85u.HMTNB |
| 1321 | 2231-88u.HMTNB |
| 1322 | 2231-94u.HMTNB |
| 1323 | 2231-95u.HMTNB |
| 1324 | 2232-03u.HMTNB |
| 1325 | 2232-11u.HMTNB |
| 1326 | 2232-19u.HMTNB |
| 1327 | 2232-25u.HMTNB |
| 1328 | 2232-30u.HMTNB |
| 1329 | 2232-44u.HMTNB |
| 1330 | 2232-50u.HMTNB |
| 1331 | 2232-56u.HMTNB |
| 1332 | 2232-60u.HMTNB |
| 1333 | 2232-64u.HMTNB |
| 1334 | 2232-71u.HMTNB |
| 1335 | 2232-73u.HMTNB |
| 1336 | 2232-80u.HMTNB |
| 1337 | 2232-83u.HMTNB |
| 1338 | 2233-02u.HMTNB |
| 1339 | 2233-53u.HMTNB |
| 1340 | 2233-57u.HMTNB |

TABLE IV-continued

| SEQ ID NO: | Name |
|---|---|
| 1341 | 2233-58u.HMTNB |
| 1342 | 2233-80u.HMTNB |
| 1343 | 2233-81u.HMTNB |
| 1344 | 2233-83u.HMTNB |
| 1345 | 2234-02u.HMTNB |
| 1346 | 2234-03u.HMTNB |
| 1347 | 2234-05u.HMTNB |
| 1348 | 2234-06u.HMTNB |
| 1349 | 2234-09u.HMTNB |
| 1350 | 2234-12u.HMTNB |
| 1351 | 2234-23u.HMTNB |
| 1352 | 2234-26u.HMTNB |
| 1353 | 2234-46u.HMTNB |
| 1354 | 2234-66u.HMTNB |
| 1355 | 2234-67u.HMTNB |
| 1356 | 2234-70u.HMTNB |
| 1357 | 2234-74u.HMTNB |
| 1358 | 2234-77u.HMTNB |
| 1359 | 2234-82u.HMTNB |
| 1360 | 2234-88u.HMTNB |
| 1361 | 2234-89u.HMTNB |
| 1362 | 2234-90u.HMTNB |
| 1363 | 2234-93u.HMTNB |
| 1364 | 2240-39 |
| 1365 | 2240-40 |
| 1366 | 2240-49 |
| 1367 | 2240-51 |
| 1368 | 2240-57 |
| 1369 | 2240-61 |
| 1370 | 2240-62 |
| 1371 | 2241-2 |
| 1372 | 2241-3 |
| 1373 | 2241-8 |
| 1374 | 2241-9 |
| 1375 | 2241-13 |
| 1376 | 2241-21 |
| 1377 | 2241-29 |
| 1378 | 2241-38 |
| 1379 | 2241-45 |
| 1380 | 2241-49 |
| 1381 | 2241-51 |
| 1382 | 2241-57 |
| 1383 | 2241-63 |
| 1384 | 2241-68 |
| 1385 | 2241-89 |
| 1386 | 2241-91 |
| 1387 | 2243-2 |
| 1388 | 2243-3 |
| 1389 | 2243-12 |
| 1390 | 2243-14 |
| 1391 | 2243-19 |
| 1392 | 2243-24 |
| 1393 | 2243-25 |
| 1394 | 2243-33 |
| 1395 | 2243-49 |
| 1396 | 2243-50 |
| 1397 | 2243-51 |
| 1398 | 2243-59 |
| 1399 | 2243-63 |
| 1400 | 2243-69 |
| 1401 | 2243-74 |
| 1402 | 2243-75 |
| 1403 | 2243-77 |
| 1404 | 2244-19 |
| 1405 | 2244-26 |
| 1406 | 2244-35 |
| 1407 | 2244-38 |
| 1408 | 2244-40 |
| 1409 | 2244-47 |
| 1410 | 2244-52 |
| 1411 | 2244-57 |
| 1412 | 2244-63 |
| 1413 | 2244-68 |
| 1414 | 2244-77 |
| 1415 | 2244-80 |

In one embodiment, a gene or other nucleic acid molecule of the present invention can be an allelic variant that includes a similar but not identical sequence to SEQ ID NO:1, SEQ ID NO:3, SEQ ID NO:4, SEQ ID NO:6, SEQ ID NO:7, SEQ ID NO:9, SEQ ID NO:10, SEQ ID NO:12, SEQ ID NO:13, SEQ ID NO:15, SEQ ID NO:16, SEQ ID NO:18, SEQ ID NO:19, SEQ ID NO:21, SEQ ID NO:22, SEQ ID NO:24, SEQ ID NO:25, SEQ ID NO:27, SEQ D NO:28, SEQ ID NO:30, SEQ ID NO:31, SEQ ID NO:33, SEQ ID NO:34, SEQ ID NO:36, SEQ ID NO:37, SEQ ID NO:39, SEQ ID NO:40, SEQ ID NO:42, SEQ ID NO:43, SEQ ID NO:45, SEQ ID NO:46, SEQ ID NO:48, SEQ ID NO:153, SEQ ID NO:155, SEQ ID NO:156, SEQ ID NO:158, SEQ ID NO:159, SEQ ID NO:161, SEQ ID NO:162, SEQ ID NO:164, SEQ ID NO:165, SEQ ID NO:167, SEQ ID NO:168, SEQ ID NO:170, SEQ ID NO:1859, SEQ ID NO:1860, SEQ ID NO:1861, SEQ ID NO:1863, SEQ ID NO:1864, SEQ ID NO:1866, SEQ D NO:1867, SEQ ID NO:1869, SEQ ID NO:1870, SEQ ID NO:1871, SEQ ID NO:1872, SEQ ID NO:1874, SEQ ID NO:1875, SEQ ID NO:1876, SEQ ID NO:1877, SEQ ID NO:1878, SEQ ID NO:1880, SEQ B NO:1881, SEQ ID NO:1882, SEQ ID NO:1884, SEQ ID NO:1885, SEQ ID NO:1886, SEQ ID NO:1887, SEQ ID NO:1889, SEQ ID NO:1890, SEQ ID NO:1891, SEQ ID NO:1892, SEQ ID NO:1893, SEQ ID NO:1894, SEQ ID NO:1895, SEQ ID NO:1896, SEQ ID NO:1898, SEQ ID NO:1899, SEQ ID NO:1900, SEQ ID NO:1901, SEQ ID NO:1903, SEQ ID NO:1904, SEQ ID NO:1905, SEQ ID NO:1906, SEQ ID NO:1907, SEQ ID NO:1908, SEQ ID NO:1909, SEQ ID NO:1910, SEQ ID NO:1911, SEQ ID NO:1912, SEQ ID NO:1913, SEQ ID NO:1914, SEQ ID NO:1916, SEQ ID NO:1917, SEQ ID NO:1918, SEQ ID NO:1919, SEQ ID NO:1921, SEQ ID NO:1922, SEQ ID NO:1923, SEQ ID NO:1924, SEQ ID NO:1926, SEQ ID NO:1927, SEQ ID NO:1928, SEQ ID NO:1929, and/or SEQ ID NO:1931 or a *C. felis* nucleic acid sequence of Table I, Table II, Table III and/or Table IV or a complement thereof. For example, an allelic variant of a *C. felis* ALN gene including SEQ ID NO:1 is a gene that occurs at essentially the same locus (or loci) in the genome as the gene including SEQ ID NO:1, but which, due to natural variations caused by, for example, mutation or recombination, has a similar but not identical sequence. Because natural selection typically selects against alterations that affect function, allelic variants (i.e. alleles corresponding to, or of, cited nucleic acid sequences) usually encode proteins having similar activity to that of the protein encoded by the gene to which they are being compared. Allelic variants of genes or nucleic acid molecules can also comprise alterations in the 5' or 3' untranslated regions of the gene (e.g., in regulatory control regions), or can involve alternative splicing of a nascent transcript, thereby bringing alternative exons into juxtaposition. Allelic variants are well known to those skilled in the art and would be expected to occur naturally within a given flea such as *C. felis*, since the genome is diploid, and sexual reproduction will result in the reassortment of alleles. For example, SEQ ID NO:162 is apparently an allelic variant or multiple gene of SEQ ID NO:153.

In one embodiment of the present invention, isolated HMT and HNC proteins are encoded by nucleic acid molecules that hybridize under stringent hybridization conditions to genes or other nucleic acid molecules encoding flea HMT and HNC proteins, respectively. The minimal size of HMT and HNC proteins of the present invention is a size sufficient to be encoded by a nucleic acid molecule capable of forming a stable hybrid (i.e., hybridizing under stringent hybridization conditions) with the complementary sequence of a nucleic acid molecule encoding the corresponding natural protein. The size of a nucleic acid molecule encoding such a protein is dependent on the nucleic acid composition and the percent homology between the flea HMT or HNC nucleic acid molecule and the complementary nucleic acid sequence. It can easily be understood that the extent of homology required to form a stable hybrid under stringent conditions can vary depending on whether the homologous sequences are interspersed throughout a given nucleic acid molecule or are clustered (i.e., localized) in distinct regions on a given nucleic acid molecule.

The minimal size of a nucleic acid molecule capable of forming a stable hybrid with a gene encoding a flea HMT or HNC protein is typically at least about 12 to about 15 nucleotides in length if the nucleic acid molecule is GC-rich and at least about 15 to about 17 bases in length if it is AT-rich. The minimal size of a nucleic acid molecule used to encode an HMT or HNC protein homologue of the present invention is from about 12 to about 18 nucleotides in length. Thus, the minimal size of HMT or HNC protein homologues of the present invention is from about 4 to about 6 amino acids in length. There is no limit, other than a practical limit, on the maximal size of a nucleic acid molecule encoding a flea HMT or HNC protein of the present invention because a nucleic acid molecule of the present invention can include a portion of a gene, an entire gene, or multiple genes. The preferred size of a protein encoded by a nucleic acid molecule of the present invention depends on whether a full-length, fusion, multivalent, or functional portion of such a protein is desired.

Stringent hybridization conditions are determined based on defined physical properties of the gene to which the nucleic acid molecule is being hybridized, and can be defined mathematically. Stringent hybridization conditions are those experimental parameters that allow an individual skilled in the art to identify significant similarities between heterologous nucleic acid molecules. These conditions are well known to those skilled in the art. See, for example, Sambrook, et al., 1989, *Molecular Cloning: A Laboratory Manual*, Cold Spring Harbor Labs Press, and Meinkoth, et al., 1984, *Anal. Biochem.* 138, 267-284, each of which is incorporated by reference herein in its entirety. As explained in detail in the cited references, the determination of hybridization conditions involves the manipulation of a set of variables including the ionic strength (M, in moles/liter), the hybridization temperature (° C.), the concentration of nucleic acid helix destabilizing agents (such as formamide), the average length of the shortest hybrid duplex (n), and the percent G+C composition of the fragment to which an unknown nucleic acid molecule is being hybridized. For nucleic acid molecules of at least about 150 nucleotides, these variables are inserted into a standard mathematical formula to calculate the melting temperature, or $T_m$, of a given nucleic acid molecule. As defined in the formula below, $T_m$ is the temperature at which two complementary nucleic acid molecule strands will disassociate, assuming 100% complementarity between the two strands:

$T_m = 81.5°$ C. $+16.6 \log M + 0.41 (\% G+C) - 500/n - 0.61 (\%$ formamide).

For nucleic acid molecules smaller than about 50 nucleotides, hybrid stability is defined by the dissociation temperature (Td), which is defined as the temperature at which 50% of the duplexes dissociate. For these smaller molecules, the stability at a standard ionic strength is defined by the following equation:

$T_d = 4(G+C) + 2(A+T)$.

A temperature of 5° C. below $T_d$ is used to detect hybridization between perfectly matched molecules.

Also well known to those skilled in the art is how base pair mismatch, i.e. differences between two nucleic acid molecules being compared, including non-complementarity of bases at a given location, and gaps due to insertion or deletion of one or more bases at a given location on either of the nucleic acid molecules being compared, will affect $T_m$ or $T_d$ for nucleic acid molecules of different sizes. For example, $T_m$ decreases about 1° C. for each 1% of mismatched base pairs for hybrids greater than about 150 bp, and Td decreases about 5° C. for each mismatched base pair for hybrids below about 50 bp. Conditions for hybrids between about 50 and about 150 base pairs can be determined empirically and without undue experimentation using standard laboratory procedures well known to those skilled in the art. These simple procedures allow one skilled in the art to set the hybridization conditions (by altering, for example, the salt concentration, the formamide concentration or the temperature) so that only nucleic acid hybrids with greater than a specified % base pair mismatch will hybridize. Stringent hybridization conditions are commonly understood by those skilled in the art to be those experimental conditions that will allow less than or equal to about 30% base pair mismatch (i.e., at least about 70% identity). Because one skilled in the art can easily determine whether a given nucleic acid molecule to be tested is less than or greater than about 50 nucleotides, and can therefore choose the appropriate formula for determining hybridization conditions, he or she can determine whether the nucleic acid molecule will hybridize with a given gene under stringent hybridization conditions and similarly whether the nucleic acid molecule will hybridize under conditions designed to allow a desired amount of base pair mismatch.

Hybridization reactions are often carried out by attaching the nucleic acid molecule to be hybridized to a solid support such as a membrane, and then hybridizing with a labeled nucleic acid molecule, typically referred to as a probe, suspended in a hybridization solution. Examples of common hybridization reaction techniques include, but are not limited to, the well-known Southern and northern blotting procedures. Typically, the actual hybridization reaction is done under non-stringent conditions, i.e., at a lower temperature and/or a higher salt concentration, and then high stringency is achieved by washing the membrane in a solution with a higher temperature and/or lower salt concentration in order to achieve the desired stringency.

For example, if the skilled artisan wished to identify a nucleic acid molecule that hybridizes under conditions that would allow less than or equal to 30% pair mismatch with a flea nucleic acid molecule of about 150 bp in length or greater, the following conditions could preferably be used. The average G+C content of flea DNA is about 37%, as calculated from known flea nucleic acid sequences. The unknown nucleic acid molecules would be attached to a support membrane, and the 150 bp probe would be labeled, e.g. with a radioactive tag. The hybridization reaction could be carried out in a solution comprising 2×SSC and 0% formamide, at a temperature of about 37° C. (low stringency conditions). Solutions of differing concentrations of SSC can be made by one of skill in the art by diluting a stock solution of 20×SSC (175.3 gram NaCl and about 88.2 gram sodium citrate in 1 liter of water, pH 7) to obtain the desired concentration of SSC. The skilled artisan would calculate the washing conditions required to allow up to 30% base pair mismatch. For example, in a wash solution comprising 1×SSC and 0% formamide, the $T_m$ of perfect hybrids would be about 77° C.:

81.5° C.+16.6 log (0.15M)+(0.41×0.37)−(500/150)−(0.61×0)=77.5° C.

Thus, to achieve hybridization with nucleic acid molecules having about 30% base pair mismatch, hybridization washes would be carried out at a temperature of less than or equal to 47.5° C. It is thus within the skill of one in the art to calculate additional hybridization temperatures based on the desired percentage base pair mismatch, formulae and G/C content disclosed herein. For example, it is appreciated by one skilled in the art that as the nucleic acid molecule to be tested for hybridization against nucleic acid molecules of the present invention having sequences specified herein becomes longer than 150 nucleotides, the $T_m$ for a hybridization reaction allowing up to 30% base pair mismatch will not vary significantly from 47.5° C.

Furthermore, it is known in the art that there are commercially available computer programs for determining the degree of similarity between two nucleic acid sequences. These computer programs include various known methods to determine the percentage identity and the number and length of gaps between hybrid nucleic acid molecules. Preferred methods to determine the percent identity among amino acid sequences and also among nucleic acid sequences include analysis using one or more of the commercially available computer programs designed to compare and analyze nucleic acid or amino acid sequences. These computer programs include, but are not limited to, the Wisconsin Package Version 9.0 sequence analysis software, available from Genetics Computer Group (GCG™), Madison, Wis., DNAsis™, available from Hitachi Software, San Bruno, Calif., and MacVector™, available from the Eastman Kodak Company, New Haven, Conn. A preferred method to determine percent identity among amino acid sequences and also among nucleic acid sequences includes using the GAP program with pair-wise comparisons within the GCG™ Wisconsin Package Version 9.0 sequence analysis software, hereinafter referred to as default parameters. One embodiment of the present invention includes flea ALN, CBP, NKAB, LGIC, ANON, MALV, OS-D, NMDA, CLBP, NAH, CLIC, PL2, PL3, PL4, SVP, VGCC, AUP, and 7B2 proteins. A preferred flea ALN protein includes a protein encoded by a nucleic acid molecule that hybridizes under conditions that preferably allow less than or equal to about 30% base pair mismatch, more preferably under conditions that allow less than or equal to about 25% base pair mismatch, more preferably under conditions that allow less than or equal to about 20% base pair mismatch, more preferably under conditions that allow less than or equal to about 15% base pair mismatch, more preferably under conditions that allow less than or equal to about 10% base pair mismatch and even more preferably under conditions that allow less than or equal to about 5% base pair mismatch with a nucleic acid molecule selected from the group consisting of SEQ ID NO:3 and SEQ ID NO:6.

A preferred flea CBP protein includes a protein encoded by a nucleic acid molecule that hybridizes under conditions that preferably allow less than or equal to about 30% base pair mismatch, more preferably under conditions that allow less than or equal to about 25% base pair mismatch, more preferably under conditions that allow less than or equal to about 20% base pair mismatch, more preferably under conditions that allow less than or equal to about 15% base pair mismatch, more preferably under conditions that allow less than or equal to about 10% base pair mismatch and even more preferably under conditions that allow less than or equal to about 5% base pair mismatch with a nucleic acid molecule selected from the group consisting of SEQ ID NO:9 and SEQ ID NO:12.

A preferred flea NKAB protein includes a protein encoded by a nucleic acid molecule that hybridizes under conditions that preferably allow less than or equal to about 30% base pair mismatch, more preferably under conditions that allow less than or equal to about 25% base pair mismatch, more preferably under conditions that allow less than or equal to about 20% base pair mismatch, more preferably under conditions that allow less than or equal to about 15% base pair mismatch, more preferably under conditions that allow less than or equal to about 10% base pair mismatch and even more preferably under conditions that allow less than or equal to about 5% base pair mismatch with a nucleic acid molecule selected from the group consisting of SEQ ID NO:15 and SEQ ID NO:18.

A preferred flea LGIC protein includes a protein encoded by a nucleic acid molecule that hybridizes under conditions that preferably allow less than or equal to about 30% base pair mismatch, more preferably under conditions that allow less than or equal to about 25% base pair mismatch, more preferably under conditions that allow less than or equal to about 20% base pair mismatch, more preferably under conditions that allow less than or equal to about 15% base pair mismatch, more preferably under conditions that allow less than or equal to about 10% base pair mismatch and even more preferably under conditions that allow less than or equal to about 5% base pair mismatch with a nucleic acid molecule selected from the group consisting of SEQ ID NO:21 and SEQ ID NO:24, SEQ ID NO:1860, SEQ ID NO:1863, and SEQ ID NO:1866.

A preferred flea ANON protein includes a protein encoded by a nucleic acid molecule that hybridizes under conditions that preferably allow less than or equal to about 30% base pair mismatch, more preferably under conditions that allow less than or equal to about 25% base pair mismatch, more preferably under conditions that allow less than or equal to about 20% base pair mismatch, more preferably under conditions that allow less than or equal to about 15% base pair mismatch, more preferably under conditions that allow less than or equal to about 10% base pair mismatch and even more preferably under conditions that allow less than or equal to about 5% base pair mismatch with a nucleic acid molecule selected from the group consisting of SEQ ID NO:27 and SEQ ID NO:30.

A preferred flea MALV protein includes a protein encoded by a nucleic acid molecule that hybridizes under conditions that preferably allow less than or equal to about 30% base pair mismatch, more preferably under conditions that allow less than or equal to about 25% base pair mismatch, more preferably under conditions that allow less than or equal to about 20% base pair mismatch, more preferably under conditions that allow less than or equal to about 15% base pair mismatch, more preferably under conditions that allow less than or equal to about 10% base pair mismatch and even more preferably under conditions that allow less than or equal to about 5% base pair mismatch with a nucleic acid molecule selected from the group consisting of SEQ ID NO:33 and SEQ ID NO:36.

A preferred flea OS-D protein includes a protein encoded by a nucleic acid molecule that hybridizes under conditions that preferably allow less than or equal to about 30% base pair mismatch, more preferably under conditions that allow less than or equal to about 25% base pair mismatch, more preferably under conditions that allow less than or equal to about 20% base pair mismatch, more preferably under conditions that allow less than or equal to about 15% base pair mismatch, more preferably under conditions that allow less than or equal to about 10% base pair mismatch and even more preferably under conditions that allow less than or equal to about 5% base pair mismatch with a nucleic acid molecule selected from the group consisting of SEQ ID NO:39 and SEQ ID NO:42.

A preferred flea NMDA protein includes a protein encoded by a nucleic acid molecule that hybridizes under conditions that preferably allow less than or equal to about 30% base pair mismatch, more preferably under conditions that allow less than or equal to about 25% base pair mismatch, more preferably under conditions that allow less than or equal to about 20% base pair mismatch, more preferably under conditions that allow less than or equal to about 15% base pair mismatch, more preferably under conditions that allow less than or equal to about 10% base pair mismatch and even more preferably under conditions that allow less than or equal to about 5% base pair mismatch with a nucleic acid molecule selected from the group consisting of SEQ ID NO:45 and SEQ ID NO:48.

A preferred flea CLBP protein includes a protein encoded by a nucleic acid molecule that hybridizes under conditions that preferably allow less than or equal to about 30% base pair mismatch, more preferably under conditions that allow less than or equal to about 25% base pair mismatch, more preferably under conditions that allow less than or equal to about 20% base pair mismatch, more preferably under conditions that allow less than or equal to about 15% base pair mismatch, more preferably under conditions that allow less than or equal to about 10% base pair mismatch and even more preferably under conditions that allow less than or equal to about 5% base pair mismatch with a nucleic acid molecule selected from the group consisting of SEQ ID NO:155, SEQ ID NO:158, SEQ ID NO:161, SEQ ID NO:164, SEQ ID NO:167 and SEQ ID NO:170.

A preferred flea NAH protein includes a protein encoded by a nucleic acid molecule that hybridizes under conditions that preferably allow less than or equal to about 30% base pair mismatch, more preferably under conditions that allow less than or equal to about 25% base pair mismatch, more preferably under conditions that allow less than or equal to about 20% base pair mismatch, more preferably under conditions that allow less than or equal to about 15% base pair mismatch, more preferably under conditions that allow less than or equal to about 10% base pair mismatch and even more preferably under conditions that allow less than or equal to about 5% base pair mismatch with a nucleic acid molecule selected from the group consisting of SEQ ID NO:1869 and SEQ ID NO:1871.

A preferred flea CLIC protein includes a protein encoded by a nucleic acid molecule that hybridizes under conditions that preferably allow less than or equal to about 30% base pair mismatch, more preferably under conditions that allow less than or equal to about 25% base pair mismatch, more preferably under conditions that allow less than or equal to about 20% base pair mismatch, more preferably under conditions that allow less than or equal to about 15% base pair mismatch, more preferably under conditions that allow less than or equal to about 10% base pair mismatch and even more preferably under conditions that allow less than or equal to about 5% base pair mismatch with a nucleic acid molecule selected from the group consisting of SEQ ID NO:1874 and SEQ ID NO:1876.

A preferred flea PL2 protein includes a protein encoded by a nucleic acid molecule that hybridizes under conditions that preferably allow less than or equal to about 30% base pair mismatch, more preferably under conditions that allow less than or equal to about 25% base pair mismatch, more preferably under conditions that allow less than or equal to about 20% base pair mismatch, more preferably under conditions that allow less than or equal to about 15% base pair mismatch, more preferably under conditions that allow less than or equal to about 10% base pair mismatch and even more preferably under conditions that allow less than or equal to about 5% base pair mismatch with a nucleic acid molecule selected from the group consisting of SEQ ID NO:1879, SEQ ID NO:1881, SEQ ID NO:1884, and SEQ ID NO:1886.

A preferred flea CPL3 protein includes a protein encoded by a nucleic acid molecule that hybridizes under conditions that preferably allow less than or equal to about 30% base pair mismatch, more preferably under conditions that allow less than or equal to about 25% base pair mismatch, more preferably under conditions that allow less than or equal to about 20% base pair mismatch, more preferably under conditions that allow less than or equal to about 15% base pair mismatch, more preferably under conditions that allow less than or equal to about 10% base pair mismatch and even more preferably under conditions that allow less than or equal to about 5% base pair mismatch with a nucleic acid molecule selected from the group consisting of SEQ ID NO:1889 and SEQ ID NO:1891.

A preferred flea PL4 protein includes a protein encoded by a nucleic acid molecule that hybridizes under conditions that preferably allow less than or equal to about 30% base pair mismatch, more preferably under conditions that allow less than or equal to about 25% base pair mismatch, more preferably under conditions that allow less than or equal to about 20% base pair mismatch, more preferably under conditions that allow less than or equal to about 15% base pair mismatch, more preferably under conditions that allow less than or equal to about 10% base pair mismatch and even more preferably under conditions that allow less than or equal to about 5% base pair mismatch with a nucleic acid molecule selected from the group consisting of SEQ ID NO:1893, SEQ ID NO:1895, SEQ ID NO:1898, and SEQ ID NO:1900.

A preferred flea SVP protein includes a protein encoded by a nucleic acid molecule that hybridizes under conditions that preferably allow less than or equal to about 30% base pair mismatch, more preferably under conditions that allow less than or equal to about 25% base pair mismatch, more preferably under conditions that allow less than or equal to about 20% base pair mismatch, more preferably under conditions that allow less than or equal to about 15% base pair mismatch, more preferably under conditions that allow less than or equal to about 10% base pair mismatch and even more preferably under conditions that allow less than or equal to about 5% base pair mismatch with a nucleic acid molecule selected from the group consisting of SEQ ID NO:1903 and SEQ ID NO:1905.

A preferred flea VGCC protein includes a protein encoded by a nucleic acid molecule that hybridizes under conditions that preferably allow less than or equal to about 30% base pair mismatch, more preferably under conditions that allow less than or equal to about 25% base pair mismatch, more preferably under conditions that allow less than or equal to about 20% base pair mismatch, more preferably under conditions that allow less than or equal to about 15% base pair mismatch, more preferably under conditions that allow less than or equal to about 10% base pair mismatch and even more preferably under conditions that allow less than or equal to about 5% base pair mismatch with a nucleic acid molecule selected from the group consisting of SEQ ID NO:1907, SEQ ID NO:1909, SEQ ID NO:1911, SEQ ID NO:1913, SEQ ID NO:1916, and SEQ ID NO:1918.

A preferred flea AUP protein includes a protein encoded by a nucleic acid molecule that hybridizes under conditions that preferably allow less than or equal to about 30% base pair mismatch, more preferably under conditions that allow less than or equal to about 25% base pair mismatch, more preferably under conditions that allow less than or equal to about 20% base pair mismatch, more preferably under conditions that allow less than or equal to about 15% base pair mismatch, more preferably under conditions that allow less than or equal to about 10% base pair mismatch and even more preferably under conditions that allow less than or equal to about 5% base pair mismatch with a nucleic acid molecule selected from the group consisting of SEQ ID NO:1921 and SEQ ID NO:1923.

A preferred flea 7B2 protein includes a protein encoded by a nucleic acid molecule that hybridizes under conditions that preferably allow less than or equal to about 30% base pair mismatch, more preferably under conditions that allow less than or equal to about 25% base pair mismatch, more preferably under conditions that allow less than or equal to about 20% base pair mismatch, more preferably under conditions that allow less than or equal to about 15% base pair mismatch, more preferably under conditions that allow less than or equal to about 10% base pair mismatch and even more preferably under conditions that allow less than or equal to about 5% base pair mismatch with a nucleic acid molecule selected from the group consisting of SEQ ID NO:1926, SEQ ID NO:1928, and SEQ ID NO:1931.

A preferred flea HMT and/or HNC protein includes a protein encoded by a nucleic acid molecule that hybridizes under conditions that preferably allow less than or equal to about 30% base pair mismatch, more preferably under conditions that allow less than or equal to about 25% base pair mismatch, more preferably under conditions that allow less than or equal to about 20% base pair mismatch, more preferably under conditions that allow less than or equal to about 15% base pair mismatch, more preferably under conditions that allow less than or equal to about 10% base pair mismatch and even more preferably under conditions that allow less than or equal to about 5% base pair mismatch with a nucleic acid molecule selected from the group consisting of a nucleic acid sequence complementary to a nucleic acid sequence of Table I, Table II, Table III and/or Table IV.

Another embodiment of the present invention includes a flea ALN protein encoded by a nucleic acid molecule that hybridizes under conditions comprising, (a) hybridizing in a solution comprising 1×SSC and 0% formamide, at a temperature of about 37° C. and (b) washing in a solution comprising 1×SSC and 0% formamide, at a temperature of about 47.5° C., to an isolated nucleic acid molecule selected from the group consisting of SEQ ID NO:3 and SEQ ID NO:6.

Another embodiment of the present invention includes a flea CBP protein encoded by a nucleic acid molecule that hybridizes under conditions comprising, (a) hybridizing in a solution comprising 1×SSC and 0% formamide, at a temperature of about 37° C. and (b) washing in a solution comprising 1×SSC and 0% formamide, at a temperature of about 47.5° C., to an isolated nucleic acid molecule selected from the group consisting of SEQ ID NO:9 and SEQ ID NO:13.

Another embodiment of the present invention includes a flea NKAB protein encoded by a nucleic acid molecule that hybridizes under conditions comprising, (a) hybridizing in a solution comprising 1×SSC and 0% formamide, at a temperature of about 37° C. and (b) washing in a solution comprising 1×SSC and 0% formamide, at a temperature of about 47.5° C., to an isolated nucleic acid molecule selected from the group consisting of SEQ ID NO:15 and SEQ ID NO:18.

Another embodiment of the present invention includes a flea LGIC protein encoded by a nucleic acid molecule that hybridizes under conditions comprising, (a) hybridizing in a solution comprising 1×SSC and 0% formamide, at a temperature of about 37° C. and (b) washing in a solution comprising 1×SSC and 0% formamide, at a temperature of about 47.5° C., to an isolated nucleic acid molecule selected from the group consisting of SEQ ID NO:21, SEQ ID NO:24, SEQ ID NO:1860, SEQ ID NO:1863, and SEQ ID NO:1866.

Another embodiment of the present invention includes a flea ANON protein encoded by a nucleic acid molecule that hybridizes under conditions comprising, (a) hybridizing in a solution comprising 1×SSC and 0% formamide, at a temperature of about 37° C. and (b) washing in a solution comprising 1×SSC and 0% formamide, at a temperature of about 47.5° C., to an isolated nucleic acid molecule selected from the group consisting of SEQ ID NO:27 and SEQ ID NO:30.

Another embodiment of the present invention includes a flea MALV protein encoded by a nucleic acid molecule that hybridizes under conditions comprising, (a) hybridizing in a solution comprising 1×SSC and 0% formamide, at a temperature of about 37° C. and (b) washing in a solution comprising 1×SSC and 0% formamide, at a temperature of about 47.5° C., to an isolated nucleic acid molecule selected from the group consisting of SEQ ID NO:33 and SEQ ID NO:36.

Another embodiment of the present invention includes a flea OS-D protein encoded by a nucleic acid molecule that hybridizes under conditions comprising, (a) hybridizing in a solution comprising 1×SSC and 0% formamide, at a temperature of about 37° C. and (b) washing in a solution comprising 1×SSC and 0% formamide, at a temperature of about 47.5° C., to an isolated nucleic acid molecule selected from the group consisting of SEQ ID NO:39 and SEQ ID NO:42.

Another embodiment of the present invention includes a flea NMDA protein encoded by a nucleic acid molecule that hybridizes under conditions comprising, (a) hybridizing in a solution comprising 1×SSC and 0% formamide, at a temperature of about 37° C. and (b) washing in a solution comprising 1×SSC and 0% formamide, at a temperature of about 47.5° C., to an isolated nucleic acid molecule selected from the group consisting of SEQ ID NO:45 and SEQ ID NO:48.

Another embodiment of the present invention includes a flea CLBP protein encoded by a nucleic acid molecule that hybridizes under conditions comprising, (a) hybridizing in a solution comprising 1×SSC and 0% formamide, at a temperature of about 37° C. and (b) washing in a solution comprising 1×SSC and 0% formamide, at a temperature of about 47.5° C., to an isolated nucleic acid molecule selected from the group consisting of SEQ ID NO:155, SEQ ID NO:158, SEQ ID NO:161, SEQ ID NO:164, SEQ ID NO:167 and SEQ ID NO:170.

Another embodiment of the present invention includes a flea NAH protein encoded by a nucleic acid molecule that hybridizes under conditions comprising, (a) hybridizing in a solution comprising 1×SSC and 0% formamide, at a temperature of about 37° C. and (b) washing in a solution comprising 1×SSC and 0% formamide, at a temperature of about 47.5° C., to an isolated nucleic acid molecule selected from the group consisting of SEQ ID NO:1869 and SEQ ID NO:1871.

Another embodiment of the present invention includes a flea CLIC protein encoded by a nucleic acid molecule that hybridizes under conditions comprising, (a) hybridizing in a solution comprising 1×SSC and 0% formamide, at a temperature of about 37° C. and (b) washing in a solution comprising 1×SSC and 0% formamide, at a temperature of about 47.5° C., to an isolated nucleic acid molecule selected from the group consisting of SEQ ID NO:1874 and SEQ ID NO:1876.

Another embodiment of the present invention includes a flea PL2 protein encoded by a nucleic acid molecule that hybridizes under conditions comprising, (a) hybridizing in a solution comprising 1×SSC and 0% formamide, at a temperature of about 37° C. and (b) washing in a solution comprising 1×SSC and 0% formamide, at a temperature of about 47.5° C., to an isolated nucleic acid molecule selected from the group consisting of SEQ ID NO:1879, SEQ ID NO:1881, SEQ ID NO:1884 and SEQ ID NO:1886.

Another embodiment of the present invention includes a flea PL3 protein encoded by a nucleic acid molecule that hybridizes under conditions comprising, (a) hybridizing in a solution comprising 1×SSC and 0% formamide, at a temperature of about 37° C. and (b) washing in a solution comprising 1×SSC and 0% formamide, at a temperature of about 47.5° C., to an isolated nucleic acid molecule selected from the group consisting of SEQ ID NO:1889 and SEQ ID NO:1891.

Another embodiment of the present invention includes a flea PL4 protein encoded by a nucleic acid molecule that hybridizes under conditions comprising, (a) hybridizing in a solution comprising 1×SSC and 0% formamide, at a temperature of about 37° C. and (b) washing in a solution comprising 1×SSC and 0% formamide, at a temperature of about 47.5° C., to an isolated nucleic acid molecule selected from the group consisting of SEQ ID NO:1893, SEQ ID NO:1895, SEQ ID NO:1898, and SEQ ID NO:1900.

Another embodiment of the present invention includes a flea SVP protein encoded by a nucleic acid molecule that hybridizes under conditions comprising, (a) hybridizing in a solution comprising 1×SSC and 0% formamide, at a temperature of about 37° C. and (b) washing in a solution comprising 1×SSC and 0% formamide, at a temperature of about 47.5° C., to an isolated nucleic acid molecule selected from the group consisting of SEQ ID NO:1903 and SEQ ID NO:1905.

Another embodiment of the present invention includes a flea VGCC protein encoded by a nucleic acid molecule that hybridizes under conditions comprising, (a) hybridizing in a solution comprising 1×SSC and 0% formamide, at a temperature of about 37° C. and (b) washing in a solution comprising 1×SSC and 0% formamide, at a temperature of about 47.5° C., to an isolated nucleic acid molecule selected from the group consisting of SEQ ID NO:1907, SEQ ID NO:1909, SEQ ID NO:1911, SEQ ID NO:1913, SEQ ID NO:1916, and SEQ ID NO:1918.

Another embodiment of the present invention includes a flea AUP protein encoded by a nucleic acid molecule that hybridizes under conditions comprising, (a) hybridizing in a solution comprising 1×SSC and 0% formamide, at a temperature of about 37° C. and (b) washing in a solution comprising 1×SSC and 0% formamide, at a temperature of about 47.5° C., to an isolated nucleic acid molecule selected from the group consisting of SEQ ID NO:1921 and SEQ ID NO:1923.

Another embodiment of the present invention includes a flea 7B2 protein encoded by a nucleic acid molecule that hybridizes under conditions comprising, (a) hybridizing in a solution comprising 1×SSC and 0% formamide, at a temperature of about 37° C. and (b) washing in a solution comprising 1×SSC and 0% formamide, at a temperature of about 47.5° C., to an isolated nucleic acid molecule selected from the group consisting of SEQ ID NO:1926, SEQ ID NO:1928, and SEQ ID NO:1931.

Another embodiment of the present invention includes a flea HMT and/or HNC protein encoded by a nucleic acid molecule that hybridizes under conditions comprising, (a) hybridizing in a solution comprising 1×SSC and 0% formamide, at a temperature of about 37° C. and (b) washing in a solution comprising 1×SSC and 0% formamide, at a temperature of about 47.5° C., to an isolated nucleic acid molecule selected from the group consisting of a nucleic acid sequence complementary to a nucleic acid sequence of Table I, Table II, Table III and/or Table IV.

Another preferred flea ALN protein of the present invention includes a protein that is encoded by a nucleic acid molecule that is preferably at least about 70% identical, more preferably at least about 75% identical, more preferably at least about 80% identical, more preferably about at least 85% identical, more preferably about at least 90% identical, and even more preferably about at least 95% identical to a nucleic acid molecule having the nucleic acid sequence SEQ ID NO:1 and/or SEQ ID NO:4; also preferred are fragments (i.e. portions) of such proteins encoded by nucleic acid molecules that are at least about 18 nucleotides. Percent identity as used herein is determined using the Compare function by maximum matching within the program DNAsis Version 2.1 using default parameters.

Another preferred flea CBP protein of the present invention includes a protein that is encoded by a nucleic acid molecule that is preferably at least about 70% identical, more preferably at least about 75% identical, more preferably at least about 80% identical, more preferably at least about 85% identical, more preferably at least about 90% identical, and even more preferably at least about 95% identical to a nucleic acid molecule having the nucleic acid sequence SEQ ID NO:7 and/or SEQ ID NO:10; also preferred are fragments (i.e. portions) of such proteins encoded by nucleic acid molecules that are at least about 18 nucleotides. Percent identity as used herein is determined using the Compare function by maximum matching within the program DNAsis Version 2.1 using default parameters.

Another preferred flea NKAB protein of the present invention includes a protein that is encoded by a nucleic acid molecule that is preferably at least about 70% identical, more preferably at least about 75% identical, more preferably at least about 80% identical, more preferably at least about 85% identical, more preferably at least about 90% identical, and even more preferably at least about 95% identical to a nucleic acid molecule having the nucleic acid sequence SEQ ID NO:13 and/or SEQ ID NO:16; also preferred are fragments (i.e. portions) of such proteins encoded by nucleic acid molecules that are at least about 18 nucleotides. Percent identity as used herein is determined using the Compare function by maximum matching within the program DNAsis Version 2.1 using default parameters.

Another preferred flea LGIC protein of the present invention includes a protein that is encoded by a nucleic acid molecule that is preferably at least about 70% identical, more preferably at least about 75% identical, more preferably at least about 80% identical, more preferably at least about 85% identical, more preferably at least about 90% identical, and even more preferably at least about 95% identical to a nucleic acid molecule having the nucleic acid sequence SEQ ID NO:19, SEQ ID NO:22, SEQ ID NO:1861, and/or SEQ ID NO:1864; also preferred are fragments (i.e. portions) of such proteins encoded by nucleic acid molecules that are at least about 18 nucleotides. Percent identity as used herein is determined using the Compare function by maximum matching within the program DNAsis Version 2.1 using default parameters.

Another preferred flea ANON protein of the present invention includes a protein that is encoded by a nucleic acid molecule that is preferably at least about 70% identical, more preferably at least about 75% identical, more preferably at least about 80% identical, more preferably at least about 85% identical, more preferably at least about 90% identical, and even more preferably at least about 95% identical to a nucleic acid molecule having the nucleic acid sequence SEQ ID NO:25 and/or SEQ ID NO:28; also preferred are fragments (i.e. portions) of such proteins encoded by nucleic acid molecules that are at least about 18 nucleotides. Percent identity as used herein is determined using the Compare function by maximum matching within the program DNAsis Version 2.1 using default parameters.

Another preferred flea MALV protein of the present invention includes a protein that is encoded by a nucleic acid molecule that is preferably at least about 70% identical, more preferably at least about 75% identical, more preferably at least about 80% identical, more preferably at least about 85% identical, more preferably at least about 90% identical, and even more preferably at least about 95% identical to a nucleic acid molecule having the nucleic acid sequence SEQ ID NO:31 and/or SEQ ID NO:34; also preferred are fragments (i.e. portions) of such proteins encoded by nucleic acid molecules that are at least about 18 nucleotides. Percent identity as used herein is determined using the Compare function by maximum matching within the program DNAsis Version 2.1 using default parameters.

Another preferred flea OS-D protein of the present invention includes a protein that is encoded by a nucleic acid molecule that is preferably at least about 70% identical, more preferably at least about 75% identical, more preferably at least about 80% identical, more preferably at least about 85% identical, more preferably at least about 90% identical, and even more preferably at least about 95% identical to a nucleic acid molecule having the nucleic acid sequence SEQ ID NO:37 and/or SEQ ID NO:40; also preferred are fragments (i.e. portions) of such proteins encoded by nucleic acid molecules that are at least about 18 nucleotides. Percent identity as used herein is determined using the Compare function by maximum matching within the program DNAsis Version 2.1 using default parameters.

Another preferred flea NMDA protein of the present invention includes a protein that is encoded by a nucleic acid molecule that is preferably at least about 70% identical, more preferably at least about 75% identical, more preferably at least about 80% identical, more preferably at least about 85% identical, more preferably at least about 90% identical, and even more preferably at least about 95% identical to a nucleic acid molecule having the nucleic acid sequence SEQ ID NO:43 and/or SEQ ID NO:46; also preferred are fragments (i.e. portions) of such proteins encoded by nucleic acid molecules that are at least about 18 nucleotides. Percent identity as used herein is determined using the Compare function by maximum matching within the program DNAsis Version 2.1 using default parameters.

Another preferred flea CLBP protein of the present invention includes a protein that is encoded by a nucleic acid molecule that is preferably at least about 70% identical, more preferably at least about 75% identical, more preferably at least about 80% identical, more preferably at least about 85% identical, more preferably at least about 90% identical, and even more preferably at least about 95% identical to a nucleic acid molecule having the nucleic acid sequence SEQ ID NO:153, SEQ ID NO:156, SEQ ID NO:159, SEQ ID NO:162, SEQ ID NO:165 and/or SEQ ID NO:168; also preferred are fragments (i.e. portions) of such proteins encoded by nucleic acid molecules that are at least about 18 nucleotides. Percent identity as used herein is determined using the Compare function by maximum matching within the program DNAsis Version 2.1 using default parameters.

Another preferred flea NAH protein of the present invention includes a protein that is encoded by a nucleic acid molecule that is preferably at least about 70% identical, more preferably at least about 75% identical, more preferably at least about 80% identical, more preferably about at least 85% identical, more preferably about at least 90% identical, and even more preferably about at least 95% identical to a nucleic acid molecule having the nucleic acid sequence SEQ ID NO:1867 and/or SEQ ID NO:1870; also preferred are fragments (i.e. portions) of such proteins encoded by nucleic acid molecules that are at least about 18 nucleotides. Percent identity as used herein is determined using the Compare function by maximum matching within the program DNAsis Version 2.1 using default parameters.

Another preferred flea CLIC protein of the present invention includes a protein that is encoded by a nucleic acid molecule that is preferably at least about 70% identical, more preferably at least about 75% identical, more preferably at least about 80% identical, more preferably about at least 85% identical, more preferably about at least 90% identical, and even more preferably about at least 95% identical to a nucleic acid molecule having the nucleic acid sequence SEQ ID NO:1872 and/or SEQ ID NO:1875; also preferred are fragments (i.e. portions) of such proteins encoded by nucleic acid molecules that are at least about 18 nucleotides. Percent identity as used herein is determined using the Compare function by maximum matching within the program DNAsis Version 2.1 using default parameters.

Another preferred flea PL2 protein of the present invention includes a protein that is encoded by a nucleic acid molecule that is preferably at least about 70% identical, more preferably at least about 75% identical, more preferably at least about 80% identical, more preferably about at least 85% identical, more preferably about at least 90% identical, and even more preferably about at least 95% identical to a nucleic acid molecule having the nucleic acid sequence SEQ ID NO:1877, SEQ ID NO:1878, SEQ ID NO:1880, SEQ ID NO:1882, and/or SEQ ID NO:1885; also preferred are fragments (i.e. portions) of such proteins encoded by nucleic acid molecules that are at least about 18 nucleotides. Percent identity as used herein is determined using the Compare function by maximum matching within the program DNAsis Version 2.1 using default parameters.

Another preferred flea PL3 protein of the present invention includes a protein that is encoded by a nucleic acid molecule that is preferably at least about 70% identical, more preferably at least about 75% identical, more preferably at least about 80% identical, more preferably about at least 85% identical, more preferably about at least 90% identical, and even more preferably about at least 95% identical to a nucleic acid molecule having the nucleic acid sequence SEQ ID NO:1887 and/or SEQ ID NO:1890; also preferred are fragments (i.e. portions) of such proteins encoded by nucleic acid molecules that are at least about 18 nucleotides. Percent identity as used herein is determined using the Compare function by maximum matching within the program DNAsis Version 2.1 using default parameters.

Another preferred flea PL4 protein of the present invention includes a protein that is encoded by a nucleic acid molecule that is preferably at least about 70% identical, more preferably at least about 75% identical, more preferably at least about 80% identical, more preferably about at least 85% identical, more preferably about at least 90% identical, and even more preferably about at least 95% identical to a nucleic acid molecule having the nucleic acid sequence SEQ ID NO:1892, SEQ ID NO:1894, SEQ ID NO:1896 and/or SEQ ID NO:1899; also preferred are fragments (i.e. portions) of such proteins encoded by nucleic acid molecules that are at least about 18 nucleotides. Percent identity as used herein is determined using the Compare function by maximum matching within the program DNAsis Version 2.1 using default parameters.

Another preferred flea SVP protein of the present invention includes a protein that is encoded by a nucleic acid molecule that is preferably at least about 70% identical, more preferably at least about 75% identical, more preferably at least about 80% identical, more preferably about at least 85% identical, more preferably about at least 90% identical, and even more preferably about at least 95% identical to a nucleic acid molecule having the nucleic acid sequence SEQ ID NO:1901 and/or SEQ ID NO:1904; also preferred are fragments (i.e. portions) of such proteins encoded by nucleic acid molecules that are at least about 18 nucleotides. Percent identity as used herein is determined using the Compare function by maximum matching within the program DNAsis Version 2.1 using default parameters.

Another preferred flea VGCC protein of the present invention includes a protein that is encoded by a nucleic acid molecule that is preferably at least about 70% identical, more preferably at least about 75% identical, more preferably at least about 80% identical, more preferably about at least 85% identical, more preferably about at least 90% identical, and even more preferably about at least 95% identical to a nucleic acid molecule having the nucleic acid sequence SEQ ID NO:1906, SEQ ID NO:1908, SEQ ID NO:1910, SEQ ID NO:1912, SEQ ID NO:1914 and/or SEQ ID NO:1917; also preferred are fragments (i.e. portions) of such proteins encoded by nucleic acid molecules that are at least about 18 nucleotides. Percent identity as used herein is determined using the Compare function by maximum matching within the program DNAsis Version 2.1 using default parameters.

Another preferred flea AUP protein of the present invention includes a protein that is encoded by a nucleic acid molecule that is preferably at least about 70% identical, more preferably at least about 75% identical, more preferably at least about 80% identical, more preferably about at least 85% identical, more preferably about at least 90% identical, and even more preferably about at least 95% identical to a nucleic acid molecule having the nucleic acid sequence SEQ ID NO:1919 and/or SEQ ID NO:1922; also preferred are fragments (i.e. portions) of such proteins encoded by nucleic acid molecules that are at least about 18 nucleotides. Percent identity as used herein is determined using the Compare function by maximum matching within the program DNAsis Version 2.1 using default parameters.

Another preferred flea 7B2 protein of the present invention includes a protein that is encoded by a nucleic acid molecule that is preferably at least about 70% identical, more preferably at least about 75% identical, more preferably at least about 80% identical, more preferably about at least 85% identical, more preferably about at least 90% identical, and even more preferably about at least 95% identical to a nucleic acid molecule having the nucleic acid sequence SEQ ID NO:1924, SEQ ID NO:1927 and/or SEQ ID NO:1929; also preferred are fragments (i.e. portions) of such proteins encoded by nucleic acid molecules that are at least about 18 nucleotides. Percent identity as used herein is determined using the Compare function by maximum matching within the program DNAsis Version 2.1 using default parameters.

Another preferred flea HMT and/or HNC protein of the present invention includes a protein that is encoded by a nucleic acid molecule that is preferably at least about 70% identical, more preferably at least about 75% identical, more preferably at least about 80% identical, more preferably at least about 85% identical, more preferably at least about 90% identical, and even more preferably at least about 95% identical to a nucleic acid molecule having a nucleic acid sequence of Table I, Table II, Table III and/or Table IV; also preferred are fragments (i.e. portions) of such proteins encoded by nucleic acid molecules that are at least about 18 nucleotides. Percent identity as used herein is determined using the Compare function by maximum matching within the program DNAsis Version 2.1 using default parameters.

Additional preferred flea ALN proteins of the present invention include proteins having the amino acid sequence SEQ ID NO:2 or SEQ ID NO:5, and proteins comprising homologues of a protein having the amino acid sequence SEQ ID NO:2 or SEQ ID NO:5, wherein such a homologue comprises at least one epitope that elicits an immune response against a protein having an amino acid sequence SEQ ID NO:2 or SEQ ID NO:5. Likewise, also preferred are proteins encoded by nucleic acid molecules comprising nucleic acid sequence SEQ ID NO:1 and/or SEQ ID NO:4, or by homologues thereof.

Additional preferred flea CBP proteins of the present invention include proteins having the amino acid sequence SEQ ID NO:8 or SEQ ID NO:11, and proteins comprising homologues of a protein having the amino acid sequence SEQ ID NO:8 or SEQ ID NO:11, wherein such a homologue comprises at least one epitope that elicits an immune response against a protein having an amino acid sequence SEQ ID NO:8 or SEQ ID NO:11. Likewise, also preferred are proteins encoded by nucleic acid molecules comprising nucleic acid sequence SEQ ID NO:7 and/or SEQ ID NO:10, or by homologues thereof.

Additional preferred flea NKAB proteins of the present invention include proteins having the amino acid sequence SEQ ID NO:14 or SEQ ID NO:17, and proteins comprising homologues of a protein having the amino acid sequence SEQ ID NO:14 or SEQ ID NO:17, wherein such a homologue comprises at least one epitope that elicits an immune response against a protein having an amino acid sequence SEQ ID NO:14 or SEQ ID NO:17. Likewise, also preferred are proteins encoded by nucleic acid molecules comprising nucleic acid sequence SEQ ID NO:13 and/or SEQ ID NO:16, or by homologues thereof.

Additional preferred flea LGIC proteins of the present invention include proteins having the amino acid sequence SEQ ID NO:20, SEQ ID NO:23 or SEQ ID NO:1862, and proteins comprising homologues of a protein having the amino acid sequence SEQ ID NO:20, SEQ ID NO:23 or SEQ ID NO:1862, wherein such a homologue comprises at least one epitope that elicits an immune response against a protein having an amino acid sequence SEQ ID NO:20, SEQ ID NO:23 or SEQ ID NO:1862. Likewise, also preferred are proteins encoded by nucleic acid molecules comprising nucleic acid sequence SEQ ID NO:19, SEQ ID NO:22, SEQ ID NO:1859, SEQ ID NO:1861 and/or SEQ ID NO:1864 or by homologues thereof.

Additional preferred flea ANON proteins of the present invention include proteins having the amino acid sequence SEQ ID NO:26 or SEQ ID NO:29, and proteins comprising homologues of a protein having the amino acid sequence SEQ ID NO:26 or SEQ ID NO:29, wherein such a homologue comprises at least one epitope that elicits an immune response against a protein having an amino acid sequence SEQ ID NO:26 or SEQ ID NO:29. Likewise, also preferred are proteins encoded by nucleic acid molecules comprising nucleic acid sequence SEQ ID NO:25 and/or SEQ ID NO:28, or by homologues thereof.

Additional preferred flea MALV proteins of the present invention include proteins having the amino acid sequence SEQ ID NO:32 or SEQ ID NO:35, and proteins comprising homologues of a protein having the amino acid sequence SEQ ID NO:32 or SEQ ID NO:35, wherein such a homologue comprises at least one epitope that elicits an immune response against a protein having an amino acid sequence SEQ ID NO:32 or SEQ ID NO:35. Likewise, also preferred are proteins encoded by nucleic acid molecules comprising nucleic acid sequence SEQ ID NO:31 and/or SEQ ID NO:34, or by homologues thereof.

Additional preferred flea OS-D proteins of the present invention include proteins having the amino acid sequence SEQ ID NO:38 or SEQ ID NO:41, and proteins comprising homologues of a protein having the amino acid sequence SEQ ID NO:38 or SEQ ID NO:41, wherein such a homologue comprises at least one epitope that elicits an immune response against a protein having an amino acid sequence SEQ ID NO:38 or SEQ ID NO:41. Likewise, also preferred are proteins encoded by nucleic acid molecules comprising nucleic acid sequence SEQ ID NO:37 and/or SEQ ID NO:40, or by homologues thereof.

Additional preferred flea NMDA proteins of the present invention include proteins having the amino acid sequence SEQ ID NO:44 or SEQ ID NO:47, and proteins comprising homologues of a protein having the amino acid sequence SEQ ID NO:44 or SEQ ID NO:47, wherein such a homologue comprises at least one epitope that elicits an immune response against a protein having an amino acid sequence SEQ ID NO:44 or SEQ ID NO:47. Likewise, also preferred are proteins encoded by nucleic acid molecules comprising nucleic acid sequence SEQ ID NO:43 and/or SEQ ID NO:46, or by homologues thereof.

Additional preferred flea CLBP proteins of the present invention include proteins having the amino acid sequence SEQ ID NO:154, SEQ ID NO:157, SEQ ID NO:160, SEQ ID NO:163, SEQ ID NO:166 or SEQ ID NO:169, and proteins comprising homologues of a protein having the amino acid sequence SEQ ID NO:154, SEQ ID NO:157, SEQ ID NO:160, SEQ ID NO:163, SEQ ID NO:166 or SEQ ID NO:169, wherein such a homologue comprises at least one epitope that elicits an immune response against a protein having an amino acid sequence SEQ ID NO:154, SEQ ID NO:157, SEQ ID NO:160, SEQ ID NO:163, SEQ ID NO:166 or SEQ ID NO:169. Likewise, also preferred are proteins encoded by nucleic acid molecules comprising nucleic acid sequence SEQ ID NO:153, SEQ ID NO:156, SEQ ID NO:159, SEQ ID NO:162, SEQ ID NO:165 and/or SEQ ID NO:168, or by homologues thereof.

Additional preferred flea NAH proteins of the present invention include proteins having the amino acid sequence SEQ ID NO:1868, and proteins comprising homologues of a protein having the amino acid sequence SEQ ID NO:1868, wherein such a homologue comprises at least one epitope that elicits an immune response against a protein having an amino acid sequence SEQ ID NO:1868. Likewise, also preferred are proteins encoded by nucleic acid molecules comprising nucleic acid sequence SEQ ID NO:1867 and/or SEQ ID NO:1870, or by homologues thereof.

Additional preferred flea CLIC proteins of the present invention include proteins having the amino acid sequence SEQ ID NO:1873, and proteins comprising homologues of a protein having the amino acid sequence SEQ ID NO:1873, wherein such a homologue comprises at least one epitope that elicits an immune response against a protein having an amino acid sequence SEQ ID NO:1873. Likewise, also preferred are proteins encoded by nucleic acid molecules comprising nucleic acid sequence SEQ ID NO:1872 and/or SEQ ID NO:1875, or by homologues thereof.

Additional preferred flea PL2 proteins of the present invention include proteins having the amino acid sequence SEQ ID NO:1883, and proteins comprising homologues of a protein having the amino acid sequence SEQ ID NO:1883, wherein such a homologue comprises at least one epitope that elicits an immune response against a protein having an amino acid sequence SEQ ID NO:1883. Likewise, also preferred are proteins encoded by nucleic acid molecules comprising nucleic acid sequence SEQ ID NO:1877, SEQ ID NO:1878, SEQ ID NO:1880, SEQ ID NO:1882 and/or SEQ ID NO:1885, or by homologues thereof.

Additional preferred flea PL3 proteins of the present invention include proteins having the amino acid sequence SEQ ID NO:1888, and proteins comprising homologues of a protein having the amino acid sequence SEQ ID NO:1888, wherein such a homologue comprises at least one epitope that elicits an immune response against a protein having an amino acid sequence SEQ ID NO:1888. Likewise, also preferred are proteins encoded by nucleic acid molecules comprising nucleic acid sequence SEQ ID NO:1887 and/or SEQ ID NO:1890, or by homologues thereof.

Additional preferred flea PL4 proteins of the present invention include proteins having the amino acid sequence SEQ ID NO:1897, and proteins comprising homologues of a protein having the amino acid sequence SEQ ID NO:1897, wherein such a homologue comprises at least one epitope that elicits an immune response against a protein having an amino acid sequence SEQ ID NO:1897. Likewise, also preferred are proteins encoded by nucleic acid molecules comprising nucleic acid sequence SEQ ID NO:1892, SEQ ID NO:1894, SEQ ID NO:1896 and/or SEQ ID NO:1899, or by homologues thereof.

Additional preferred flea SVP proteins of the present invention include proteins having the amino acid sequence SEQ ID NO:1902, and proteins comprising homologues of a protein having the amino acid sequence SEQ ID NO:1902, wherein such a homologue comprises at least one epitope that elicits an immune response against a protein having an amino acid sequence SEQ ID NO:1902. Likewise, also preferred are proteins encoded by nucleic acid molecules comprising nucleic acid sequence SEQ ID NO:1901 and/or SEQ ID NO:1904, or by homologues thereof.

Additional preferred flea VGCC proteins of the present invention include proteins having the amino acid sequence SEQ ID NO:1915, and proteins comprising homologues of a protein having the amino acid sequence SEQ ID NO:1915, wherein such a homologue comprises at least one epitope that elicits an immune response against a protein having an amino acid sequence SEQ ID NO:1915. Likewise, also preferred are proteins encoded by nucleic acid molecules comprising nucleic acid sequence SEQ ID NO:1906, SEQ ID NO:1908, SEQ ID NO:1910, SEQ ID NO:1912, SEQ ID NO:1914 and/or SEQ ID NO:1917, or by homologues thereof.

Additional preferred flea AUP proteins of the present invention include proteins having the amino acid sequence SEQ ID NO:1920, and proteins comprising homologues of a protein having the amino acid sequence SEQ ID NO:1920, wherein such a homologue comprises at least one epitope that elicits an immune response against a protein having an amino acid sequence SEQ ID NO:1920. Likewise, also preferred are proteins encoded by nucleic acid molecules comprising nucleic acid sequence SEQ ID NO:1919 and/or SEQ ID NO:1922, or by homologues thereof.

Additional preferred flea 7B2 proteins of the present invention include proteins having the amino acid sequence SEQ ID NO:1925 or SEQ ID NO:1930, and proteins comprising homologues of a protein having the amino acid sequence SEQ ID NO:1925 or SEQ ID NO:1930, wherein such a homologue comprises at least one epitope that elicits an immune response against a protein having an amino acid sequence SEQ ID NO:1925 or SEQ ID NO:1930. Likewise, also preferred are proteins encoded by nucleic acid molecules comprising nucleic acid sequence SEQ ID NO:1924, SEQ ID NO:1927 and/or SEQ ID NO:1929, or by homologues thereof.

Additional preferred flea HMT and/or HNC proteins of the present invention include proteins having an amino acid sequence encoded by a nucleic acid sequence of Table I, Table II, Table III and/or Table IV, and proteins comprising homologues of a protein encoded by a nucleic acid sequence of Table I, Table II, Table III and/or Table IV, wherein such a homologue comprises at least one epitope that elicits an immune response against a protein encoded by a nucleic acid sequence of Table I, Table II, Table III and/or Table IV.

A preferred isolated protein of the present invention is a protein encoded by at least one of the following nucleic acid molecules: $nCfALN_{2057}$, $nCfALN_{1152}$, $nCfCBP_{1128}$, $nCfCBP_{816}$, $nCfNKAB_{1714}$, $nCfNKAB_{978}$, $nCfLGIC_{2240}$, $nCfLGIC_{1707}$, $nCfANON_{1429}$, $nCfANON_{1194}$, $nCfMALV_{76}5$, $nCfMALV_{762}$, $nCfOSD_{604}$, $nCfOSD_{405}$, $nCfNMDA_{1227}$, $nCfNMDA_{738}$, $nCfCLBP1A_{633}$, $nCfCLBP1A_{441}$, $nCfCLBP2A_{631}$, $nCfCLBP2A_{441}$, $nCfLGIC_{2739}$, $nCfLGIC_{2016}$, $nCfNAH_{2080}$, $nCfNAH_{1824}$, $nCfCLIC_{2283}$, $nCfCLIC_{786}$, $nCfPL2_{1291}$, $nCfPL2_{1173}$, $nCfPL3_{406}$, $nCfPL3_{243}$, $nCfPL4_{974}$, $nCfPL4_{1043}$, $nCfPL4_{1062}$, $nCfPL4_{855}$, $nCfSVP_{1875}$, $nCfSVP_{1590}$, $nCfVGCC_{381}$, $nCfVGCC_{2191}$, $nCfVGCC_{1968}$, $nCfVGCC_{673}$, $nCfVGCC_{3126}$, $nCfVGCC_{2553}$, $nCfAUP_{1181}$, $nCfAUP_{306}$, $nCf7B2_{2161}$, $nCf7B2_{801}$, $nCf7B2_{741}$ or allelic variants of any of these nucleic acid molecules. Another preferred isolated protein is encoded by a nucleic acid molecule having nucleic acid sequence SEQ ID NO:1, SEQ ID NO:4, SEQ ID NO:7, SEQ ID NO:10, SEQ ID NO:13, SEQ ID NO:16, SEQ ID NO:19, SEQ ID NO:22, SEQ ID NO:25, SEQ ID NO:28, SEQ ID NO:31, SEQ ID NO:34, SEQ ID NO:37, SEQ ID NO:40, SEQ ID NO:43, SEQ ID NO:46, SEQ ID NO:153, SEQ ID NO:156, SEQ ID NO:159, SEQ ID NO:162, SEQ ID NO:165, SEQ ID NO:168, SEQ ID NO:1859, SEQ ID NO:1861, SEQ ID NO:1864, SEQ ID NO:1867, SEQ ID NO:1870, SEQ ID NO:1872, SEQ ID NO:1875, SEQ ID NO:1877, SEQ ID NO:1878, SEQ ID NO:1881, SEQ ID NO:1882, SEQ ID NO:1885, SEQ ID NO:1887, SEQ ID NO:1890, SEQ ID NO:1892, SEQ ID NO:1894, SEQ ID NO:1896, SEQ ID NO:1899, SEQ ID NO:1901, SEQ ID NO:1904, SEQ ID NO:1906, SEQ ID NO:1908, SEQ ID NO:1910, SEQ ID NO:1912, SEQ ID NO:1914, SEQ ID NO:1917, SEQ ID NO:1919, SEQ ID NO:1922, SEQ ID NO:1924, SEQ ID NO:1927, and/or SEQ ID NO:1929; or a protein encoded by an allelic variant of any of these listed nucleic acid molecules.

Preferred proteins of the present invention include proteins that are at least about 70%, preferably at least about 80%, more preferably at least about 85%, even more preferably at least about 90%, even more preferably at least about 95%, and even more preferably about 100% identical to $PCfALN_{384}$, $PCfCBP_{272}$, $PCfNKAB_{326}$, $PCfLGIC_{569}$, $PCfANON_{398}$, $PCfMALV_{254}$, $PCfOSD_{135}$, $PCfNMDA_{246}$, $PCfCLBP1A_{147}$ or $PCfCLBP2A_{147}$. Additionally preferred are proteins encoded by allelic variants of a nucleic acid molecules encoding proteins $PCfALN_{384}$, $PCfCBP_{272}$, $PCfNKAB_{326}$, $PCfLGIC_{569}$, $PCfANON_{398}$, $PCfMALV_{254}$, $PCfOSD_{135}$, $PCfNMDA_{246}$, $PCfCLBP1A_{147}$, $PCfCLBP2A_{147}$, $PCfLGIC_{672}$, $PCfNAH_{608}$, $PCfCLIC_{262}$, $PCfPL2_{39}$, $PCfPL3_{81}$, $PCfPL4_{285}$, $PCfSVP_{530}$, $PCfVGCC_{851}$, $PCfAUP_{102}$, $PCf7B2_{267}$, $PCf7B2_{247}$. Also preferred are fragments thereof having at least about 6 amino acid residues.

Other preferred HMT and HNC proteins of the present invention include proteins having amino acid sequences that are at least about 70%, preferably at least about 80%, more preferably at least about 85%, even more preferably at least about 90%, even more preferably at least about 95%, and even more preferably about 100% identical to amino acid sequence SEQ ID NO:2, SEQ ID NO:8, SEQ ID NO:14, SEQ ID NO:20, SEQ ID NO:26, SEQ ID NO:32, SEQ ID NO:38, SEQ ID NO:44, SEQ ID NO:154, SEQ ID NO:160, SEQ ID NO:163, SEQ ID NO:169, SEQ ID NO:1862, SEQ ID NO:1868, SEQ ID NO:1873, SEQ ID NO:1879, SEQ ID NO:1883, SEQ ID NO:1888, SEQ ID NO:1897, SEQ ID NO:1902, SEQ ID NO:1915, SEQ ID NO:1920, SEQ ID NO:1925, and/or SEQ ID NO:1930; and proteins encoded by allelic variants of nucleic acid molecules encoding HMT and HNC proteins having amino acid sequences SEQ ID NO:2, SEQ ID NO:8, SEQ ID NO:14, SEQ ID NO:20, SEQ ID NO:26, SEQ ID NO:32, SEQ ID NO:38, SEQ ID NO:44, SEQ ID NO:154, SEQ ID NO:160, SEQ ID NO:163, SEQ ID NO:169, SEQ ID NO:1862, SEQ ID NO:1868, SEQ ID NO:1873, SEQ ID NO:1879, SEQ ID NO:1883, SEQ ID NO:1888, SEQ ID NO:1897, SEQ ID NO:1902, SEQ ID NO:1915, SEQ ID NO:1920, SEQ ID NO:1925, and/or SEQ ID NO:1930. Also preferred are fragments thereof having at least about 6 amino acid residues.

In one embodiment of the present invention, *C. felis* HMT and HNC proteins comprise amino acid sequence SEQ ID NO:2, SEQ ID NO:8, SEQ ID NO:14, SEQ ID NO:20, SEQ ID NO:26, SEQ ID NO:32, SEQ ID NO:38, SEQ ID NO:44, SEQ ID NO:154, SEQ ID NO:160, SEQ ID NO:163, SEQ ID NO:169, SEQ ID NO:1862, SEQ ID NO:1868, SEQ ID NO:1873, SEQ ID NO:1879, SEQ ID NO:1883, SEQ ID NO:1888, SEQ ID NO:1897, SEQ ID NO:1902, SEQ ID NO:1915, SEQ ID NO:1920, SEQ ID NO:1925, and/or SEQ ID NO:1930 (including, but not limited to, the proteins consisting of amino acid sequence SEQ ID NO:2, SEQ ID NO:8, SEQ ID NO:14, SEQ ID NO:20, SEQ ID NO:26, SEQ ID NO:32, SEQ ID NO:38, SEQ ID NO:44, SEQ ID NO:154, SEQ ID NO:160, SEQ ID NO:163, SEQ ID NO:169, SEQ ID NO:1862, SEQ ID NO:1868, SEQ ID NO:1873, SEQ ID NO:1879, SEQ ID NO:1883, SEQ ID NO:1888, SEQ ID NO:1897, SEQ ID NO:1902, SEQ ID NO:1915, SEQ ID NO:1920, SEQ ID NO:1925, and/or SEQ ID NO:1930, fusion proteins and multivalent proteins), and proteins encoded by allelic variants of nucleic acid molecules encoding proteins having amino acid sequence SEQ ID NO:2, SEQ ID NO:8, SEQ ID NO:14, SEQ ID NO:20, SEQ ID NO:26, SEQ ID NO:32, SEQ ID NO:38, SEQ ID NO:44, SEQ ID NO:154, SEQ ID NO:160, SEQ ID NO:163, SEQ ID NO:169, SEQ ID NO:1862, SEQ ID NO:1868, SEQ ID NO:1873, SEQ ID NO:1879, SEQ ID NO:1883, SEQ ID NO:1888, SEQ ID NO:1897, SEQ ID NO:1902, SEQ ID NO:1915, SEQ ID NO:1920, SEQ ID NO:1925, and/or SEQ ID NO:1930.

In one embodiment, a preferred flea HMT or HNC protein comprises an amino acid sequence of at least about 35 amino acids, preferably at least about 50 amino acids, more preferably at least about 100 amino acids, more preferably at least about 200 amino acids, more preferably at least about 250 amino acids, more preferably at least about 300 amino acids, more preferably at least about 350 amino acids, more preferably at least about 400 amino acids, more preferably at least about 450 amino acids, more preferably at least about 500 amino acids, even more preferably at least about 550 amino acids, and even more preferably at least about 575 amino acids. In another embodiment, preferred flea HMT and HNC proteins comprise full-length proteins, i.e., proteins encoded by full-length coding regions, or post-translationally modified proteins thereof, such as mature proteins from which initiating methionine and/or signal sequences or "pro" sequences have been removed.

A fragment of an HMT and/or HNC protein of the present invention preferably comprises at least about 5 amino acids, more preferably at least about 10 amino acids, more preferably at least about 15 amino acids, more preferably at least about 20 amino acids, more preferably at least about 25 amino acids, more preferably at least about 30 amino acids, more preferably at least about 35 amino acids, more preferably at least about 40 amino acids, more preferably at least about 45 amino acids, more preferably at least about 50 amino acids, more preferably at least about 55 amino acids, more preferably at least about 60 amino acids, more preferably at least about 65 amino acids, more preferably at least about 70 amino acids, more preferably at least about 75 amino acids, more preferably at least about 80 amino acids, more preferably at least about 85 amino acids, more preferably at least about 90 amino acids, more preferably at least about 95 amino acids, and even more preferably at least about 100 amino acids in length.

Additional preferred HMT and HNC proteins of the present invention include proteins encoded by nucleic acid molecules comprising at least a portion of nCfALN$_{2057}$, nCfALN$_{1152}$, nCfCBP$_{1128}$, nCfCBP$_{816}$, nCfNKAB$_{1714}$, nCfNKAB$_{978}$, nCfLGIC$_{2240}$, nCfLGIC$_{1707}$, nCfANON$_{1429}$, nCfANON$_{1194}$, nCfMALV$_{765}$, nCfMALV$_{762}$, nCfOSD$_{604}$, nCfOSD$_{405}$, nCfNMDA$_{1227}$, nCfNMDA$_{738}$, nCfCLBP1A$_{633}$, nCfCLBP1A$_{441}$, nCfCLBP2A$_{631}$, nCfCLBP2A$_{441}$, nCfLGIC$_{2739}$, nCfLGIC$_{2016}$, nCfNAH$_{2080}$, nCfNAH$_{1824}$, nCfCLIC$_{2283}$, nCfCLIC$_{786}$, nCfPL2$_{1291}$, nCfPL2$_{1173}$, nCfPL3$_{406}$, nCfPL3$_{243}$, nCfPL4$_{974}$, nCfPL4$_{1043}$, nCfPL4$_{1062}$, nCfPL4$_{855}$, nCfSVP$_{1875}$, nCfSVP$_{1590}$, nCfVGCC$_{381}$, nCfVGCC$_{2191}$, nCfVGCC$_{1968}$, nCfVGCC$_{673}$, nCfVGCC$_{3126}$, nCfVGCC$_{2553}$, nCfAUP$_{1181}$, nCfAUP$_{306}$, nCf7B2$_{2161}$, nCf7B2$_{801}$, nCf7B2$_{741}$ as well as HMT and HNC proteins encoded by allelic variants of such nucleic acid molecules. A portion of such HMT and HNC nucleic acid molecule is preferably at least 18 nucleotides in length.

Also preferred are HMT and HNC proteins encoded by nucleic acid molecules having nucleic acid sequences comprising at least a portion of SEQ ID NO:1, SEQ ID NO:4, SEQ ID NO:7, SEQ ID NO:10, SEQ ID NO:13, SEQ ID NO:16, SEQ ID NO:19, SEQ ID NO:22, SEQ ID NO:25, SEQ ID NO:28, SEQ ID NO:31, SEQ ID NO:34, SEQ ID NO:37, SEQ ID NO:40, SEQ ID NO:43, SEQ ID NO:46, SEQ ID NO:153, SEQ ID NO:156, SEQ ID NO:159, SEQ ID NO:162, SEQ ID NO:165, SEQ ID NO:168, SEQ ID NO:1859, SEQ ID NO:1861, SEQ ID NO:1864, SEQ ID NO:1867, SEQ ID NO:1870, SEQ ID NO:1872, SEQ ID NO:1875, SEQ ID NO:1877, SEQ ID NO:1878, SEQ ID NO:1881, SEQ ID NO:1882, SEQ ID NO:1885, SEQ ID NO:1887, SEQ ID NO:1890, SEQ ID NO:1892, SEQ ID NO:1894, SEQ ID NO:1896, SEQ ID NO:1899, SEQ ID NO:1901, SEQ ID NO:1904, SEQ ID NO:1906, SEQ ID NO:1908, SEQ ID NO:1910, SEQ ID NO:1912, SEQ ID NO:1914, SEQ ID NO:1917, SEQ ID NO:1919, SEQ ID NO:1922, SEQ ID NO:1924, SEQ ID NO:1927, and/or SEQ ID NO:1929, as well as allelic variants of these nucleic acid molecules. A portion of such HMT and HNC nucleic acid molecule is preferably at least 18 nucleotides in length.

In another embodiment, a preferred flea HMT and/or HNC protein of the present invention is encoded by a nucleic acid molecule comprising at least about 15 nucleotides, more preferably at least about 18 nucleotides, more preferably at least about 20 nucleotides, more preferably at least about 25 nucleotides, more preferably at least about 30 nucleotides, more preferably at least about 40 nucleotides, more preferably at least about 50 nucleotides, more preferably at least about 100 nucleotides, more preferably at least about 150 nucleotides, more preferably at least about 350 nucleotides, more preferably at least about 450 nucleotides, more preferably at least about 550 nucleotides, more preferably at least about 650 nucleotides, more preferably at least about 750 nucleotides, more preferably at least about 1000 nucleotides, more preferably at least about 1500 nucleotides, more preferably at least about 1750 nucleotides more preferably at least about 2000 nucleotides, and even more preferably at least about 2250 nucleotides in length. Within this embodiment is a HMT protein encoded by at least a portion of nCfALN$_{2057}$, nCfALN$_{1152}$, nCfCBP$_{1128}$, nCfCBP$_{816}$, nCfNKAB$_{1714}$, nCfNKAB$_{978}$ nCfLGIC$_{2240}$, nCfLGIC$_{1707}$, nCfANON$_{1429}$, nCfANON$_{1194}$, nCfMALV$_{765}$, nCfMALV$_{762}$, nCfOSD$_{604}$, nCfOSD$_{405}$, nCNMDA$_{1227}$, nCfNMDA$_{738}$, nCfCLBP1A$_{633}$, nCfCLBP1A$_{441}$, nCfCLBP2A$_{633}$, nCfCLBP2A$_{441}$, nCfLGIC$_{2739}$, nCfLGIC$_{2016}$, nCfNAH$_{2080}$, nCfNAH$_{1824}$, nCfCLIC$_{2283}$, nCfCLIC$_{786}$, nCfPL2$_{1291}$, nCfPL2$_{1173}$, nCfPL3$_{406}$, nCfPL3$_{243}$, nCfPL4$_{974}$, nCfPL4$_{1043}$, nCfPL4$_{1062}$, nCfPL4$_{855}$, nCfSVP$_{1875}$, nCfSVP$_{1590}$, nCfVGCC$_{381}$, nCfVGCC$_{2191}$, nCfVGCC$_{1968}$, nCfVGCC$_{673}$, nCfVGCC$_{3126}$, nCfVGCC$_{2553}$, nCfAUP$_{1181}$, nCfAUP$_{306}$, nCf7B2$_{2161}$, nCf7B2$_{801}$, nCf7B2$_{741}$ or by an allelic variant of any of these nucleic acid molecules. In yet another embodiment, preferred flea HMT and HNC proteins of the present invention are encoded by nucleic acid molecules comprising apparently full-length HMT or HNC coding regions respectively, i.e., nucleic acid molecules encoding an apparently full-length HMT or HNC proteins.

Preferred flea HMT and HNC proteins of the present invention can be used to develop inhibitors that, when administered to an animal in an effective manner, are capable of protecting that animal from flea infestation. In accordance with the present invention, the ability of an inhibitor of the present invention to protect an animal from flea infestation refers to the ability of that protein to, for example, treat, ameliorate and/or prevent infestation caused by fleas. In particular, the phrase "to protect an animal from flea infestation" refers to reducing the potential for flea population expansion on and around the animal (i.e., reducing the flea burden). Preferably, the flea population size is decreased, optimally to an extent that the animal is no longer bothered by fleas. A host animal, as used herein, is an animal from which fleas can feed by attaching to and feeding through the skin of the animal. Fleas, and other ectoparasites, can live on a host animal for an extended period of time or can attach temporarily to an animal in order to feed. At any given time, a certain percentage of a flea population can be on a host animal whereas the remainder can be in the environment of the animal. Such an environment can include not only adult fleas, but also flea eggs and/or flea larvae. The environment can be of any size such that fleas in the environment are able to jump onto and off of a host animal. For example, the environment of an animal can include plants, such as crops, from which fleas infest an animal. As such, it is desirable not only to reduce the flea burden on an animal per se, but also to reduce the flea burden in the environment of the animal.

Suitable fleas to target include any flea that is essentially incapable of causing disease in an animal administered an inhibitor of the present invention. As such, fleas to target include any flea that produces a protein that can be targeted by an inhibitory compound that inhibits a flea HMT or HNC protein function, thereby resulting in the decreased ability of the parasite to cause disease in an animal. Preferred fleas to target include fleas of the following genera: *Ctenocephalides, Cyopsyllus, Diamanus (Oropsylla), Echidnophaga, Nosopsyllus, Pulex, Tunga,* and *Xenopsylla*, with those of the species *Ctenocephalides canis, Ctenocephalides felis, Diamanus montanus, Echidnophaga gallinacea, Nosopsyllus faciatus, Pulex irritans, Pulex simulans, Tunga penetrans* and *Xenopsylla cheopis* being more preferred, with *C. felis* being even more preferred. Such fleas are also preferred for the isolation of proteins or nucleic acid molecules of the present invention.

One embodiment of a flea HMT and/or HNC protein of the present invention is a fusion protein that includes a flea HMT and/or HNC protein-containing domain attached to one or more fusion segments. Suitable fusion segments for use with the present invention include, but are not limited to, segments that can: enhance a protein's stability; act as an immunopotentiator to enhance an immune response against a flea HMT and/or HNC protein; and/or assist in purification of a flea HMT and/or HNC protein (e.g., by affinity chromatography). A suitable fusion segment can be a domain of any size that has the desired function (e.g., imparts increased stability, imparts increased immunogenicity to a protein, and/or simplifies purification of a protein). Fusion segments can be joined to amino and/or carboxyl termini of the flea HMT-containing and/or HNC-containing domain of the protein and can be susceptible to cleavage in order to enable straight-forward recovery of a flea HMT and/or HNC protein. Fusion proteins are preferably produced by culturing a recombinant cell transformed with a fusion nucleic acid molecule that encodes a protein including the fusion segment attached to either the carboxyl and/or amino terminal end of an HMT-containing and/or HNC-containing domain. Preferred fusion segments include a metal binding domain (e.g., a poly-histidine segment); an immunoglobulin binding domain (e.g., Protein A; Protein G; T cell; B cell; Fc receptor or complement protein antibody-binding domains); a sugar binding domain (e.g., a maltose binding domain); and/or a "tag" domain (e.g., at least a portion of β-galactosidase, a strep tag peptide, a T7 tag peptide, a Flag™ peptide, or other domains that can be purified using compounds that bind to the domain, such as monoclonal antibodies). More preferred fusion segments include metal binding domains, such as a poly-histidine segment; a maltose binding domain; a strep tag peptide, such as that available from Biometra in Tampa, Fla.; and an S10 peptide.

The present invention also includes mimetopes of flea HMT and/or HNC proteins of the present invention. As used herein, a mimetope of a flea HMT and/or HNC protein of the present invention refers to any compound that is able to mimic the activity of such an HMT and/or HNC protein, often because the mimetope has a structure that mimics the particular HMT and/or HNC protein. Mimetopes can be, but are not limited to: peptides that have been modified to decrease their susceptibility to degradation such as all-D retro peptides; anti-idiotypic and/or catalytic antibodies, or fragments thereof; non-proteinaceous immunogenic portions of an isolated protein (e.g., carbohydrate structures); and synthetic or natural organic molecules, including nucleic acids. Such mimetopes can be designed using computer-generated structures of proteins of the present invention. Mimetopes can also be obtained by generating random samples of molecules, such as oligonucleotides, peptides or other organic molecules, and screening such samples by affinity chromatography techniques using the corresponding binding partner.

Another embodiment of the present invention is an isolated nucleic acid molecule comprising a flea HMT and/or HNC nucleic acid molecule, i.e. a nucleic acid molecule that can be isolated from a HMT cDNA library, from a HNC cDNA library, or from both libraries. As used herein, HMT and HNC nucleic acid molecules has the same meaning as HMT and/or HNC nucleic acid molecule. The identifying characteristics of such nucleic acid molecules are heretofore described. A nucleic acid molecule of the present invention can include an isolated natural flea HMT and/or HNC gene or a homologue thereof, the latter of which is described in more detail below. A nucleic acid molecule of the present invention can include one or more regulatory regions, full-length or partial coding regions, or combinations thereof. The minimal size of a nucleic acid molecule of the present invention is a size sufficient to allow the formation of a stable hybrid (i.e., hybridization under stringent hybridization conditions) with the complementary sequence of another nucleic acid molecule. As such, the minimal size of a HMT and/or HNC nucleic acid molecule of the present invention is from about 12 to about 18 nucleotides in length. Suitable and preferred fleas from which to isolate nucleic acid molecules of the present invention are disclosed herein. Particularly preferred HMT and/or HNC nucleic acid molecules include *C. felis* HMT and/or HNC nucleic acid molecules.

In accordance with the present invention, an isolated nucleic acid molecule is a nucleic acid molecule that has been removed from its natural milieu (i.e., that has been subjected to human manipulation) and can include DNA, RNA, or derivatives of either DNA or RNA. As such, "isolated" does not reflect the extent to which the nucleic acid molecule has been purified. Isolated flea HMT and/or HNC nucleic acid molecules of the present invention, or homologues thereof, can be isolated from a natural source or produced using recombinant DNA technology (e.g., polymerase chain reaction (PCR) amplification or cloning) or chemical synthesis. Isolated flea HMT and/or HNC nucleic acid molecules, and homologues thereof, can include, for example, natural allelic variants and nucleic acid molecules modified by nucleotide insertions, deletions, substitutions, and/or inversions in a manner such that the modifications do not substantially interfere with the nucleic acid molecule's ability to encode a HMT and/or HNC protein of the present invention.

A flea HMT and/or HNC nucleic acid molecule homologue can be produced using a number of methods known to those skilled in the art, see, for example, Sambrook et al., ibid., is incorporated by reference herein in its entirety. For example, nucleic acid molecules can be modified using a variety of techniques including, but not limited to, classic mutagenesis and recombinant DNA techniques such as site-directed mutagenesis, chemical treatment, restriction enzyme cleavage, ligation of nucleic acid fragments, PCR amplification, synthesis of oligonucleotide mixtures and ligation of mixture groups to "build" a mixture of nucleic acid molecules, and combinations thereof. Nucleic acid molecule homologues can be selected by hybridization with flea HMT and/or HNC nucleic acid molecules or by screening the function of a protein encoded by the nucleic acid molecule (e.g., ability to elicit an immune response against at least one epitope of a flea HMT or HNC protein or to effect HMT or HNC activity).

An isolated nucleic acid molecule of the present invention can include a nucleic acid sequence that encodes at least one flea HMT or HNC protein of the present invention, examples of such proteins being disclosed herein. Although the phrase "nucleic acid molecule" primarily refers to the physical nucleic acid molecule and the phrase "nucleic acid sequence" primarily refers to the sequence of nucleotides on the nucleic acid molecule, the two phrases can be used interchangeably, especially with respect to a nucleic acid molecule, or a nucleic acid sequence, being capable of encoding a flea HMT or HNC protein.

A preferred nucleic acid molecule of the present invention, when administered to an animal, is capable of protecting that animal from flea infestation. As will be disclosed in more detail below, such a nucleic acid molecule can be, or encode, an antisense RNA, a molecule capable of triple helix formation, a ribozyme, or other nucleic acid-based drug compound. In additional embodiments, a nucleic acid molecule of the present invention can encode a protective protein (e.g., an HMT or HNC protein of the present invention), the nucleic acid molecule being delivered to the animal, for example, by direct injection (i.e, as a genetic vaccine) or in a vehicle such as a recombinant virus vaccine or a recombinant cell vaccine.

In one embodiment of the present invention, a preferred flea HMT and/or HNC nucleic acid molecule includes an isolated nucleic acid molecule that hybridizes under conditions that preferably allow less than or equal to about 30% base pair mismatch, more preferably under conditions that allow less than or equal to about 25% base pair mismatch, more preferably under conditions that allow less than or equal to about 20% base pair mismatch, more preferably under conditions that allow less than or equal to about 15% base pair mismatch, more preferably under conditions that allow less than or equal to about 10% base pair mismatch and even more preferably under conditions that allow less than or equal to about 5% base pair mismatch with a nucleic acid molecule selected from the group consisting of SEQ ID NO:1, SEQ ID NO:3, SEQ ID NO:4, SEQ ID NO:6, SEQ ID NO:7, SEQ ID NO:9, SEQ ID NO:10, SEQ ID NO:12, SEQ ID NO:13, SEQ ID NO:15, SEQ ID NO:16, SEQ ID NO:18, SEQ ID NO:19, SEQ ID NO:21, SEQ ID NO:22, SEQ ID NO:24, SEQ ID NO:25, SEQ ID NO:27, SEQ ID NO:28, SEQ ID NO:30, SEQ ID NO:31, SEQ ID NO:33, SEQ ID NO:34, SEQ ID NO:36, SEQ ID NO:37, SEQ ID NO:39, SEQ ID NO:40, SEQ ID NO:42, SEQ ID NO:43, SEQ ID NO:45, SEQ ID NO:46, SEQ ID NO:48, SEQ ID NO:153, SEQ ID NO:155, SEQ ID NO:156, SEQ ID NO:158, SEQ ID NO:159, SEQ ID NO:161, SEQ ID NO:162, SEQ ID NO:164, SEQ ID NO:165, SEQ ID NO:167, SEQ ID NO:168, SEQ ID NO:170, SEQ ID NO:1859, SEQ ID NO:1860, SEQ ID NO:1861, SEQ ID NO:1863, SEQ ID NO:1864, SEQ ID NO:1866, SEQ ID NO:1867, SEQ ID NO:1869, SEQ ID NO:1870, SEQ ID NO:1871, SEQ ID NO:1872, SEQ ID NO:1874, SEQ ID NO:1875, SEQ ID NO:1876, SEQ ID NO:1877, SEQ ID NO:1878, SEQ ID NO:1880, SEQ ID NO:1881, SEQ ID NO:1882, SEQ ID NO:1884, SEQ ID NO:1885, SEQ ID NO:1886, SEQ ID NO:1887, SEQ ID NO:1889, SEQ ID NO:1890, SEQ ID NO:1891, SEQ ID NO:1892, SEQ ID NO:1893, SEQ ID NO:1894, SEQ ID NO:1895, SEQ ID NO:1896, SEQ ID NO:1898, SEQ ID NO:1899, SEQ ID NO:1900, SEQ ID NO:1901, SEQ ID NO:1903, SEQ ID NO:1904, SEQ ID NO:1905, SEQ ID NO:1906, SEQ ID NO:1907, SEQ ID NO:1908, SEQ ID NO:1909, SEQ ID NO:1910, SEQ ID NO:1911, SEQ ID NO:1912, SEQ ID NO:1913, SEQ ID NO:1914, SEQ ID NO:1916, SEQ ID NO:1917, SEQ D NO:1918, SEQ ID NO:1919, SEQ ID NO:1921, SEQ ID NO:1922, SEQ ID NO:1923, SEQ ID NO:1924, SEQ ID NO:1926, SEQ ID NO:1927, SEQ ID NO:1928, SEQ ID NO:1929, and/or SEQ ID NO:1931, a nucleic acid molecule of Table I, Table II, Table III or Table IV and/or a nucleic acid molecule that is complementary to a nucleic acid molecule of Table I, Table II, Table III or Table IV.

Another embodiment of the present invention includes a HMT and/or HNC nucleic acid molecule, wherein said nucleic acid molecule hybridizes, in a solution comprising 1×SSC and 0% formamide, at a temperature of about 47.5° C., to an isolated nucleic acid molecule selected from the group consisting of SEQ ID NO:1, SEQ ID NO:3, SEQ ID NO:4, SEQ ID NO:6, SEQ ID NO:7, SEQ ID NO:9, SEQ ID NO:10, SEQ ID NO:12, SEQ ID NO:13, SEQ ID NO:15, SEQ ID NO:16, SEQ ID NO:18, SEQ ID NO:19, SEQ ID NO:21, SEQ ID NO:22, SEQ ID NO:24, SEQ ID NO:25, SEQ ID NO:27, SEQ ID NO:28, SEQ ID NO:30, SEQ ID NO:31, SEQ ID NO:33, SEQ ID NO:34, SEQ ID NO:36, SEQ ID NO:37, SEQ ID NO:39, SEQ ID NO:40, SEQ ID NO:42, SEQ ID NO:43, SEQ ID NO:45, SEQ ID NO:46, SEQ ID NO:48, SEQ ID NO:153, SEQ ID NO:155, SEQ ID NO:156, SEQ ID NO:158, SEQ ID NO:159, SEQ ID NO:161, SEQ ID NO:162, SEQ ID NO:164, SEQ ID NO:165, SEQ ID NO:167, SEQ ID NO:168, SEQ ID NO:170, SEQ ID NO:1859, SEQ ID NO:1860, SEQ D NO:1861, SEQ ID NO:1863, SEQ ID NO:1864, SEQ ID NO:1866, SEQ ID NO:1867, SEQ ID NO:1869, SEQ ID NO:1870, SEQ ID NO:1871, SEQ ID NO:1872, SEQ ID NO:1874, SEQ ID NO:1875, SEQ ID NO:1876, SEQ ID NO:1877, SEQ ID NO:1878, SEQ ID NO:1880, SEQ ID NO:1881, SEQ ID NO:1882, SEQ ID NO:1884, SEQ ID NO:1885, SEQ ID NO:1886, SEQ ID NO:1887, SEQ ID NO:1889, SEQ ID NO:1890, SEQ ID NO:1891, SEQ ID NO:1892, SEQ ID NO:1893, SEQ ID NO:1894, SEQ ID NO:1895, SEQ ID NO:1896, SEQ ID NO:1898, SEQ ID NO:1899, SEQ ID NO:1900, SEQ ID NO:1901, SEQ ID NO:1903, SEQ ID NO:1904, SEQ ID NO:1905, SEQ ID NO:1906, SEQ ID NO:1907, SEQ B NO:1908, SEQ ID NO:1909, SEQ ID NO:1910, SEQ ID NO:1911, SEQ ID NO:1912, SEQ ID NO:1913, SEQ ID NO:1914, SEQ ID NO:1916, SEQ ID NO:1917, SEQ ID NO:1918, SEQ ID NO:1919, SEQ ID NO:1921, SEQ ID NO:1922, SEQ ID NO:1923, SEQ ID NO:1924, SEQ ID NO:1926, SEQ ID NO:1927, SEQ ID NO:1928, SEQ ID NO:1929, and/or SEQ ID NO:1931, a nucleic acid molecule of Table I, Table II, Table III or Table IV and/or a nucleic acid molecule that is complementary to a nucleic acid molecule of Table I, Table II, Table III or Table IV. Additional preferred nucleic acid molecules of the present invention include oligonucleotides of an isolated nucleic acid molecule, wherein said nucleic acid molecule hybridizes, in a solution comprising 1×SSC and 0% formamide, at a temperature of about 47.5° C., to an isolated nucleic acid molecule selected from the group consisting of SEQ ID NO:1, SEQ ID NO:3, SEQ ID NO:4, SEQ ID NO:6, SEQ ID NO:7, SEQ ID NO:9, SEQ ID NO:10, SEQ ID NO:12, SEQ ID NO:13, SEQ ID NO:15, SEQ ID NO:16, SEQ ID NO:18, SEQ ID NO:19, SEQ ID NO:21, SEQ ID NO:22, SEQ ID NO:24, SEQ ID NO:25, SEQ ID NO:27, SEQ ID NO:28, SEQ ID NO:30, SEQ ID NO:31, SEQ ID NO:33, SEQ ID NO:34, SEQ ID NO:36, SEQ ID NO:37, SEQ ID NO:39, SEQ ID NO:40, SEQ ID NO:42, SEQ ID NO:43, SEQ ID NO:45, SEQ ID NO:46, SEQ ID NO:48, SEQ ID NO:153, SEQ ID NO:155, SEQ ID NO:156, SEQ ID NO:158, SEQ ID NO:159, SEQ ID NO:161, SEQ ID NO:162, SEQ ID NO:164, SEQ ID NO:165, SEQ ID NO:167, SEQ ID NO:168, SEQ ID NO:170, SEQ ID NO:1859, SEQ ID NO:1860, SEQ ID NO:1861, SEQ ID NO:1863, SEQ ID NO:1864, SEQ ID NO:1866, SEQ ID NO:1867, SEQ ID NO:1869, SEQ ID NO:1870, SEQ ID NO:1871, SEQ ID NO:1872, SEQ ID NO:1874, SEQ ID NO:1875, SEQ ID NO:1876, SEQ ID NO:1877, SEQ ID NO:1878, SEQ ID NO:1880, SEQ ID NO:1881, SEQ ID NO:1882, SEQ ID NO:1884, SEQ ID NO:1885, SEQ ID NO:1886, SEQ ID NO:1887, SEQ ID NO:1889, SEQ ID NO:1890, SEQ ID NO:1891, SEQ ID NO:1892, SEQ ID NO:1893, SEQ ID NO:1894, SEQ ID NO:1895, SEQ ID NO:1896, SEQ ID NO:1898, SEQ B NO:1899, SEQ ID NO:1900, SEQ ID NO:1901, SEQ ID NO:1903, SEQ ID NO:1904, SEQ ID NO:1905, SEQ ID NO:1906, SEQ ID NO:1907, SEQ ID NO:1908, SEQ ID NO:1909, SEQ ID NO:1910, SEQ ID NO:1911, SEQ B NO:1912, SEQ ID NO:1913, SEQ ID NO:1914, SEQ ID NO:1916, SEQ ID NO:1917, SEQ ID NO:1918, SEQ ID NO:1919, SEQ ID NO:1921, SEQ ID NO:1922, SEQ ID NO:1923, SEQ ID NO:1924, SEQ ID NO:1926, SEQ ID NO:1927, SEQ ID NO:1928, SEQ ID NO:1929, and/or SEQ ID NO:1931, a nucleic acid molecule of Table I, Table II, Table III or Table IV and/or a nucleic acid molecule that is complementary to a nucleic acid molecule of Table I, Table II, Table III or Table IV, wherein said oligonucleotide comprises at least about 18 nucleotides.

Additional preferred flea HMT and/or HNC nucleic acid molecules of the present invention include nucleic acid molecules comprising a nucleic acid sequence that is preferably at least about 70%, more preferably at least about 75%, more preferably at least about 80% more preferably at least about 85%, more preferably at least about 90%, and even more preferably at least about 95% identical to a nucleic acid sequence selected from the group consisting of SEQ ID NO:1, SEQ ID NO:3, SEQ ID NO:4, SEQ ID NO:6, SEQ ID NO:7, SEQ ID NO:9, SEQ ID NO:10, SEQ ID NO:12, SEQ ID NO:13, SEQ ID NO:15, SEQ ID NO:16, SEQ ID NO:18, SEQ ID NO:19, SEQ ID NO:21, SEQ ID NO:22, SEQ ID NO:24, SEQ ID NO:25, SEQ ID NO:27, SEQ ID NO:28, SEQ ID NO:30, SEQ ID NO:31, SEQ ID NO:33, SEQ ID NO:34, SEQ ID NO:36, SEQ ID NO:37, SEQ ID NO:39, SEQ ID NO:40, SEQ ID NO:42, SEQ ID NO:43, SEQ ID NO:45, SEQ ID NO:46, SEQ ID NO:48, SEQ ID NO:153, SEQ ID NO:155, SEQ ID NO:156, SEQ ID NO:158, SEQ ID NO:159, SEQ ID NO:161, SEQ ID NO:162, SEQ ID NO:164, SEQ ID NO:165, SEQ ID NO:167, SEQ ID NO:168, SEQ ID NO:170, SEQ ID NO:1859, SEQ ID NO:1860, SEQ ID NO:1861, SEQ ID NO:1863, SEQ ID NO:1864, SEQ ID NO:1866, SEQ ID NO:1867, SEQ ID NO:1869, SEQ ID NO:1870, SEQ ID NO:1871, SEQ ID NO:1872, SEQ ID NO:1874, SEQ ID NO:1875, SEQ ID NO:1876, SEQ ID NO:1877, SEQ D NO:1878, SEQ ID NO:1880, SEQ ID NO:1881, SEQ ID NO:1882, SEQ ID NO:1884, SEQ ID NO:1885, SEQ ID NO:1886, SEQ ID NO:1887, SEQ ID NO:1889, SEQ ID NO:1890, SEQ ID NO:1891, SEQ ID NO:1892, SEQ ID NO:1893, SEQ ID NO:1894, SEQ ID NO:1895, SEQ ID NO:1896, SEQ ID NO:1898, SEQ ID NO:1899, SEQ ID NO:1900, SEQ ID NO:1901, SEQ ID NO:1903, SEQ ID NO:1904, SEQ ID NO:1905, SEQ ID NO:1906, SEQ ID NO:1907, SEQ ID NO:1908, SEQ ID NO:1909, SEQ ID NO:1910, SEQ ID NO:1911, SEQ ID NO:1912, SEQ ID NO:1913, SEQ ID NO:1914, SEQ ID NO:1916, SEQ ID NO:1917, SEQ ID NO:1918, SEQ ID NO:1919, SEQ ID NO:1921, SEQ ID NO:1922, SEQ ID NO:1923, SEQ ID NO:1924, SEQ ID NO:1926, SEQ ID NO:1927, SEQ ID NO:1928, SEQ ID NO:1929, and/or SEQ ID NO:1931, a nucleic acid molecule of Table I, Table II, Table III or Table IV and/or a nucleic acid molecule that is complementary to a nucleic acid molecule of Table I, Table II, Table III or Table IV. Also preferred are oligonucleotides of any of such nucleic acid molecules. Percent identity may be determined using the GCG™ Wisconsin Package Version 9.0 sequence analysis software, using default parameters.

One embodiment of the present invention is a nucleic acid molecule comprising all or part of nucleic acid molecules nCfALN$_{2057}$, nCfALN$_{1152}$, nCfCBP$_{1128}$, nCfCBP$_{816}$, nCfNKAB$_{1714}$, nCfNKAB$_{978}$, nCfLGIC$_{2240}$, nCfLGIC$_{1707}$, nCfANON$_{1429}$, nCfANON$_{1194}$, nCfMALV$_{765}$, nCfMALV$_{762}$, nCfOSD$_{604}$, nCfOSD$_{405}$, nCfNMDA$_{1227}$, nCfNMDA$_{738}$, nCfCLBP1A$_{633}$, nCfCLBP1A$_{441}$, nCfCLBP2A$_{63}$, nCfCLBP2A$_{441}$, nCfLGIC$_{2739}$, nCfLGIC$_{2016}$, nCfNAH$_{2080}$, nCfNAH$_{1824}$, nCfCLIC$_{2283}$, nCfCLIC$_{786}$, nCfPL2$_{1291}$, nCfPL2$_{1173}$, nCfPL3$_{406}$, nCfPL3$_{243}$, nCfPL4$_{974}$, nCfPL4$_{1043}$, nCfPL4$_{1062}$, nCfPL4$_{855}$, nCfSVP$_{1875}$, nCfSVP$_{1590}$, nCfVGCC$_{381}$, nCfVGCC$_{2191}$, nCfVGCC$_{1968}$, nCfVGCC$_{673}$, nCfVGCC$_{3126}$, nCfVGCC$_{2553}$, nCfAUP$_{1118}$, nCfAUP$_{306}$, nCf7B2$_{2161}$, nCf7B2$_{801}$, nCf7B2$_{741}$ or allelic variants of these nucleic acid molecules. Another preferred nucleic acid molecule of the present invention includes at least a portion of nucleic acid sequence SEQ ID NO:1, SEQ ID NO:3, SEQ ID NO:4, SEQ ID NO:6, SEQ ID NO:7, SEQ ID NO:9, SEQ ID NO:10, SEQ ID NO:12, SEQ ID NO:13, SEQ ID NO:15, SEQ ID NO:16, SEQ ID NO:18, SEQ ID NO:19, SEQ ID NO:21, SEQ ID NO:22, SEQ ID NO:24, SEQ ID NO:25, SEQ ID NO:27, SEQ ID NO:28, SEQ ID NO:30, SEQ ID NO:31, SEQ ID NO:33, SEQ ID NO:34, SEQ ID NO:36, SEQ ID NO:37, SEQ ID NO:39, SEQ ID NO:40, SEQ ID NO:42, SEQ ID NO:43, SEQ ID NO:45, SEQ ID NO:46, SEQ ID NO:48, SEQ ID NO:153, SEQ ID NO:155, SEQ ID NO:156, SEQ ID NO:158, SEQ ID NO:159, SEQ ID NO:161, SEQ ID NO:162, SEQ ID NO:164, SEQ ID NO:165, SEQ ID NO:167, SEQ ID NO:168, SEQ ID NO:170, SEQ ID NO:1859, SEQ ID NO:1860, SEQ ID NO:1861, SEQ ID NO:1863, SEQ ID NO:1864, SEQ ID NO:1866, SEQ ID NO:1867, SEQ ID NO:1869, SEQ ID NO:1870, SEQ ID NO:1871, SEQ ID NO:1872, SEQ ID NO:1874, SEQ ID NO:1875, SEQ ID NO:1876, SEQ ID NO:1877, SEQ ID NO:1878, SEQ ID NO:1880, SEQ ID NO:1881, SEQ ID NO:1882, SEQ ID NO:1884, SEQ ID NO:1885, SEQ ID NO:1886, SEQ ID NO:1887, SEQ ID NO:1889, SEQ ID NO:1890, SEQ ID NO:1891, SEQ ID NO:1892, SEQ ID NO:1893, SEQ ID NO:1894, SEQ ID NO:1895, SEQ ID NO:1896, SEQ ID NO:1898, SEQ ID NO:1899, SEQ ID NO:1900, SEQ ID NO:1901, SEQ ID NO:1903, SEQ ID NO:1904, SEQ ID NO:1905, SEQ ID NO:1906, SEQ ID NO:1907, SEQ ID NO:1908, SEQ ID NO:1909, SEQ ID NO:1910, SEQ ID NO:1911, SEQ ID NO:1912, SEQ ID NO:1913, SEQ ID NO:1914, SEQ ID NO:1916, SEQ ID NO:1917, SEQ ID NO:1918, SEQ ID NO:1919, SEQ ID NO:1921, SEQ ID NO:1922, SEQ ID NO:1923, SEQ ID NO:1924, SEQ ID NO:1926, SEQ ID NO:1927, SEQ ID NO:1928, SEQ ID NO:1929, and/or SEQ ID NO:1931, and/or a nucleic acid molecule of Table I, Table II, Table III or Table IV, as well as allelic variants of nucleic acid molecules having these nucleic acid sequences and homologues of nucleic acid molecules having these nucleic acid sequences; preferably such a homologue encodes or is complementary to a nucleic acid molecule that encodes at least one epitope that elicits an immune response against a protein having an amino acid sequence SEQ ID NO:2, SEQ ID NO:8, SEQ ID NO:14, SEQ ID NO:20, SEQ ID NO:26, SEQ ID NO:32, SEQ ID NO:38, SEQ ID NO:44, SEQ ID NO:154, SEQ ID NO:160, SEQ ID NO:163, SEQ ID NO:169, SEQ ID NO:1862, SEQ ID NO:1868, SEQ ID NO:1873, SEQ ID NO:1879, SEQ ID NO:1883, SEQ ID NO:1888, SEQ ID NO:1897, SEQ ID NO:1902, SEQ ID NO:1915, SEQ ID NO:1920, SEQ ID NO:1925, and/or SEQ ID NO:1930. Such nucleic acid molecules can include nucleotides in addition to those included in the SEQ ID NOs, such as, but not limited to, a full-length gene, a full-length coding region, a nucleic acid molecule encoding a fusion protein, or a nucleic acid molecule encoding a multivalent protective compound.

In one embodiment, HMT and/or HNC nucleic acid molecule of the present invention encodes a protein that is at least about 70%, preferably at least about 75%, more preferably at least about 80%, even more preferably at least about 85%, even more preferably at least about 90%, even more preferably at least about 95%, even more preferably at least about 98%, and even more preferably at least about 100% identical to PCfALN$_{384}$, PCfCBP$_{272}$, PCfNKAB$_{326}$, PCfLGIC$_{569}$, PCfANON$_{398}$, PCfMALV$_{254}$, PCfOSD$_{135}$, PCfNMDA$_{246}$, PCfCLBP1A$_{147}$, PCfCLBP2A$_{147}$, PCfLGIC$_{672}$, PCfNAH$_{608}$, PCfCLIC$_{262}$, PCfPL2$_{391}$, PCfPL3$_{81}$, PCfPL4$_{285}$, PCfSVP$_{530}$, PCfVGCC$_{851}$, PCfAUP$_{102}$, PCf7B2$_{267}$, PCf7B2$_{247}$ and/or a protein encoded by a nucleic acid molecule having a sequence of Table I, Table II, Table III and/or Table IV.

In one embodiment, a HMT and/or HNC nucleic acid molecule of the present invention encodes a protein having an amino acid sequence that is at least about 70%, preferably at least about 75%, more preferably at least about 80%, even more preferably at least about 85%, even more preferably at least about 90%, even more preferably at least about 95%, even more preferably at least about 98%, and even more preferably at least about 100% identical to SEQ ID NO:2, SEQ ID NO:8, SEQ ID NO:14, SEQ ID NO:20, SEQ ID NO:26, SEQ ID NO:32, SEQ ID NO:38, SEQ ID NO:44, SEQ ID NO:154, SEQ ID NO:160, SEQ ID NO:163, SEQ ID NO:169, SEQ ID NO:1862, SEQ ID NO:1868, SEQ ID NO:1873, SEQ ID NO:1879, SEQ ID NO:1883, SEQ ID NO:1888, SEQ ID NO:1897, SEQ ID NO:1902, SEQ ID NO:1915, SEQ ID NO:1920, SEQ ID NO:1925, and/or SEQ ID NO:1930 and/or a protein encoded by a nucleic acid molecule having a sequence of Table I, Table II, Table III and/or Table IV. The present invention also includes a HMT and/or HNC nucleic acid molecule encoding a protein having at least a portion of SEQ ID NO:2, SEQ ID NO:8, SEQ ID NO:14, SEQ ID NO:20, SEQ ID NO:26, SEQ ID NO:32, SEQ ID NO:38, SEQ ID NO:44, SEQ ID NO:154, SEQ ID NO:160, SEQ ID NO:163, SEQ ID NO:169, SEQ ID NO:1862, SEQ ID NO:1868, SEQ ID NO:1873, SEQ ID NO:1879, SEQ ID NO:1883, SEQ ID NO:1888, SEQ ID NO:1897, SEQ ID NO:1902, SEQ ID NO:1915, SEQ ID NO:1920, SEQ ID NO:1925, and/or SEQ ID NO:1930 and/or a protein encoded by a nucleic acid molecule having a sequence of Table I, Table II, Table III and/or Table IV, as well as allelic variants of a nucleic acid molecule encoding a protein having these sequences, including nucleic acid molecules that have been modified to accommodate codon usage properties of the cells in which such nucleic acid molecules are to be expressed.

In another embodiment, a preferred flea HMT and/or HNC nucleic acid molecule of the present invention comprises a nucleic acid molecule comprising at least about 15 nucleotides, more preferably at least about 18 nucleotides, more preferably at least about 20 nucleotides, more preferably at least about 25 nucleotides, more preferably at least about 30 nucleotides, more preferably at least about 40 nucleotides, more preferably at least about 50 nucleotides, more preferably at least about 100 nucleotides, more preferably at least about 150 nucleotides, more preferably at least about 350 nucleotides, more preferably at least about 450 nucleotides, more preferably at least about 550 nucleotides, more preferably at least about 650 nucleotides, more preferably at least about 750 nucleotides, more preferably at least about 1000 nucleotides, more preferably at least about 1500 nucleotides, more preferably at least about 1750 nucleotides more preferably at least about 2000 nucleotides, and even more preferably at least about 2250 nucleotides in length.

In another embodiment, a preferred flea HMT and/or HNC nucleic acid molecule encodes a protein comprising at least about 5 amino acids, preferably at least about 6 amino acids, more preferably at least about 10 amino acids, more preferably at least about 15 amino acids, more preferably at least about 20 amino acids, more preferably at least about 25 amino acids, more preferably at least about 30 amino acids, more preferably at least about 40 amino acids, more preferably at least about 50 amino acids, more preferably at least about 100 amino acids, more preferably at least about 150 amino acids, more preferably at least about 200 amino acids, more preferably at least about 300 amino acids, more preferably at least about 400 amino acids, more preferably at least about 500 amino acids, even more preferably at least about 560 amino acids in length.

In another embodiment, a preferred flea HMT and/or HNC nucleic acid molecule of the present invention comprises an apparently full-length HMT and/or HNC coding region, i.e., the preferred nucleic acid molecule encodes an apparently full-length HMT and/or HNC protein, or a post-translationally modified protein thereof. In one embodiment, a preferred HMT and/or HNC nucleic acid molecule of the present invention encodes a mature protein.

In another embodiment, a preferred flea HMT and/or HNC nucleic acid molecule of the present invention comprises a nucleic acid molecule comprising SEQ ID NO:1, SEQ ID NO:3, SEQ ID NO:4, SEQ ID NO:6, SEQ ID NO:7, SEQ ID NO:9, SEQ ID NO:10, SEQ ID NO:12, SEQ ID NO:13, SEQ ID NO:15, SEQ ID NO:16, SEQ ID NO:18, SEQ ID NO:19, SEQ ID NO:21, SEQ ID NO:22, SEQ ID NO:24, SEQ ID NO:25, SEQ ID NO:27, SEQ ID NO:28, SEQ ID NO:30, SEQ ID NO:31, SEQ ID NO:33, SEQ ID NO:34, SEQ ID NO:36, SEQ ID NO:37, SEQ ID NO:39, SEQ ID NO:40, SEQ ID NO:42, SEQ ID NO:43, SEQ ID NO:45, SEQ ID NO:46, SEQ ID NO:48, SEQ ID NO:153, SEQ ID NO:155, SEQ ID NO:156, SEQ ID NO:158, SEQ ID NO:159, SEQ ID NO:161, SEQ ID NO:162, SEQ ID NO:164, SEQ ID NO:165, SEQ ID NO:167, SEQ ID NO:168, SEQ ID NO:170, SEQ ID NO:1859, SEQ ID NO:1860, SEQ ID NO:1861, SEQ ID NO:1863, SEQ ID NO:1864, SEQ ID NO:1866, SEQ ID NO:1867, SEQ ID NO:1869, SEQ ID NO:1870, SEQ ID NO:1871, SEQ ID NO:1872, SEQ ID NO:1874, SEQ ID NO:1875, SEQ ID NO:1876, SEQ ID NO:1877, SEQ ID NO:1878, SEQ ID NO:1880, SEQ ID NO:1881, SEQ ID NO:1882, SEQ ID NO:1884, SEQ ID NO:1885, SEQ ID NO:1886, SEQ ID NO:1887, SEQ ID NO:1889, SEQ ID NO:1890, SEQ ID NO:1891, SEQ ID NO:1892, SEQ ID NO:1893, SEQ ID NO:1894, SEQ ID NO:1895, SEQ ID NO:1896, SEQ ID NO:1898, SEQ ID NO:1899, SEQ ID NO:1900, SEQ ID NO:1901, SEQ ID NO:1903, SEQ ID NO:1904, SEQ ID NO:1905, SEQ ID NO:1906, SEQ ID NO:1907, SEQ ID NO:1908, SEQ ID NO:1909, SEQ ID NO:1910, SEQ ID NO:1911, SEQ ID NO:1912, SEQ ID NO:1913, SEQ ID NO:1914, SEQ ID NO:1916, SEQ ID NO:1917, SEQ ID NO:1918, SEQ ID NO:1919, SEQ ID NO:1921, SEQ ID NO:1922, SEQ ID NO:1923, SEQ ID NO:1924, SEQ ID NO:1926, SEQ ID NO:1927, SEQ ID NO:1928, SEQ ID NO:1929, and/or SEQ ID NO:1931.

Knowing the nucleic acid sequences of certain flea HMT and/or HNC nucleic acid molecules of the present invention allows one skilled in the art to, for example, (a) make copies of those nucleic acid molecules, (b) obtain nucleic acid molecules including at least a portion of such nucleic acid molecules (e.g., nucleic acid molecules including full-length genes, full-length coding regions, regulatory control sequences, truncated coding regions), and (c) obtain other flea HMT and/or HNC nucleic acid molecules. Such nucleic acid molecules can be obtained in a variety of ways including screening appropriate expression libraries with antibodies of the present invention; traditional cloning techniques using oligonucleotide probes of the present invention to screen appropriate libraries; and PCR amplification of appropriate libraries or DNA using oligonucleotide primers of the present invention. Preferred libraries to screen or from which to amplify nucleic acid molecules include flea $1^{st}$ instar larvae; $3^{rd}$ instar larvae, wandering larvae, prepupal larvae, pupae and whole adult flea cDNA libraries as well as genomic DNA libraries. Similarly, preferred DNA sources to screen or from which to amplify nucleic acid molecules include flea prepupal cDNA, adult cDNA and genomic DNA. Techniques to clone and amplify genes are disclosed, for example, in Sambrook et al., ibid.

The present invention also includes nucleic acid molecules that are oligonucleotides capable of hybridizing, under stringent hybridization conditions, with complementary regions of other, preferably longer, nucleic acid molecules of the present invention such as those comprising C. felis HMT and/or HNC nucleic acid molecules or other flea HMT and/or HNC nucleic acid molecules. Oligonucleotides of the present invention can be RNA, DNA, or derivatives of either. The minimum size of such oligonucleotides is the size required for formation of a stable hybrid between an oligonucleotide and a complementary sequence on a nucleic acid molecule of the present invention. A preferred oligonucleotide of the present invention has a maximum size of preferably about 100 to 200 nucleotides. The present invention includes oligonucleotides that can be used as, for example, probes to identify nucleic acid molecules, primers to produce nucleic acid molecules, or therapeutic reagents to inhibit flea HMT and/or HNC protein production or activity (e.g., as antisense-, triplex formation-, ribozyme- and/or RNA drug-based reagents). The present invention also includes the use of such oligonucleotides to protect animals from disease using one or more of such technologies. Appropriate oligonucleotide-containing therapeutic compositions can be administered to an animal using techniques known to those skilled in the art.

One embodiment of the present invention includes a recombinant vector, which includes at least one isolated nucleic acid molecule of the present invention, inserted into any vector capable of delivering the nucleic acid molecule into a host cell. Such a vector contains heterologous nucleic acid sequences, that is nucleic acid sequences that are not naturally found adjacent to nucleic acid molecules of the present invention and that preferably are derived from a species other than the species from which the nucleic acid molecule(s) are derived. The vector can be either RNA or DNA, either prokaryotic or eukaryotic, and typically is a virus or a plasmid. Recombinant vectors can be used in the cloning, sequencing, and/or otherwise manipulating of flea HMT and/or HNC nucleic acid molecules of the present invention.

One type of recombinant vector, referred to herein as a recombinant molecule, comprises a nucleic acid molecule of the present invention operatively linked to an expression vector. The phrase operatively linked refers to insertion of a nucleic acid molecule into an expression vector in a manner such that the molecule is able to be expressed when transformed into a host cell. As used herein, an expression vector is a DNA or RNA vector that is capable of transforming a host cell and of effecting expression of a specified nucleic acid molecule. Preferably, the expression vector is also capable of replicating within the host cell. Expression vectors can be either prokaryotic or eukaryotic, and are typically viruses or plasmids. Expression vectors of the present invention include any vectors that function (i.e., direct gene expression) in recombinant cells of the present invention, including in bacterial, fungal, parasite, insect, other animal, and plant cells. Preferred expression vectors of the present invention can direct gene expression in bacterial, yeast, insect and mammalian cells, and more preferably in the cell types disclosed herein. In particular, expression vectors of the present invention contain regulatory sequences such as transcription control sequences, translation control sequences, origins of replication, and other regulatory sequences that are compatible with the recombinant cell and that control the expression of nucleic acid molecules of the present invention. In particular, recombinant molecules of the present invention include transcription control sequences. Transcription control sequences are sequences that control the initiation, elongation, and termination of transcription. Particularly important transcription control sequences are those which control transcription initiation, such as promoter, enhancer, operator and repressor sequences. Suitable transcription control sequences include any transcription control sequence that can function in at least one of the recombinant cells of the present invention. A variety of such transcription control sequences are known to those skilled in the art. Preferred transcription control sequences include those that function in bacterial, yeast, or insect and mammalian cells, such as, but not limited to, tac, lac, trp, trc, oxy-pro, omp/lpp, rmB, bacteriophage lambda (such as lambda PL and lambda PR and fusions that include such promoters), bacteriophage T7, T7lac, bacteriophage T3, bacteriophage SP6, bacteriophage SP01, metallothionein, alpha-mating factor, *Pichia* alcohol oxidase, alphavirus subgenomic promoter, antibiotic resistance ene, baculovirus, *Heliothis zea* insect virus, vaccinia virus, herpesvirus, raccoon poxvirus, other poxvirus, adenovirus, cytomegalovirus (such as immediate early promoter), simian virus 40, retrovirus, actin, retroviral long terminal repeat, Rous sarcoma virus, heat shock, phosphate and nitrate transcription control sequences as well as other sequences capable of controlling gene expression in prokaryotic or eukaryotic cells. Additional suitable transcription control sequences include tissue-specific promoters and enhancers as well as lymphokine-inducible promoters (e.g., promoters inducible by interferons or interleukins). Transcription control sequences of the present invention can also include naturally occurring transcription control sequences naturally associated with fleas, such as *C. felis* transcription control sequences.

Suitable and preferred nucleic acid molecules to include in recombinant vectors of the present invention are as disclosed herein. Preferred nucleic acid molecules to include in recombinant vectors, and particularly in recombinant molecules, include nucleic acid molecules having a sequence of Table I, Table II, Table III and/or Table IV. Particularly preferred nucleic acid molecules to include in recombinant vectors, and particularly in recombinant molecules, include $nCfALN_{2057}$, $nCfALN_{1152}$, $nCfCBP_{1128}$, $nCfCBP_{816}$, $nCfNKAB_{714}$, $nCfNKAB_{978}$ $nCfLGIC_{2240}$, $nCfLGIC_{1707}$, $nCfANON_{1429}$, $nCfANON_{1194}$, $nCfMALV_{765}$, $nCfMALV_{762}$, $nCfOSD_{604}$, $nCfOSD_{405}$, $nCfNMDA_{1227}$, $nCfNMDA_{738}$, $nCfCLBP1A_{633}$, $nCfCLBP1A_{441}$, $nCfCLBP2A_{631}$, $nCfCLBP2A_{441}$, $nCfLGIC_{2739}$, $nCfLGIC_{2016}$, $nCfNAH_{2080}$, $nCfNAH_{1824}$, $nCfCLIC_{2283}$, $nCfCLIC_{786}$, $nCfPL2_{1291}$, $nCfPL2_{1173}$, $nCfPL3_{406}$, $nCfPL3_{243}$, $nCfPL4_{974}$, $nCfPL4_{1043}$, $nCfPL4_{1062}$, $nCfPL4_{855}$, $nCfSVP_{1875}$, $nCfSVP_{1590}$, $nCfVGCC_{381}$, $nCfVGCC_{2191}$, $nCfVGCC_{1968}$, $nCfVGCC_{673}$, $nCfVGCC_{3126}$, $nCfVGCC_{25}3$, $nCfAUP_{1181}$, $nCfAUP_{306}$, $nCf7B2_{2161}$, $nCf7B_{2801}$, $nCf7B2_{741}$.

Recombinant molecules of the present invention may also (a) contain secretory signals (i.e., signal segment nucleic acid sequences) to enable an expressed flea protein of the present invention to be secreted from the cell that produces the protein and/or (b) contain fusion sequences which lead to the expression of nucleic acid molecules of the present invention as fusion proteins. Examples of suitable signal segments include any signal segment capable of directing the secretion of a protein of the present invention. Preferred signal segments include, but are not limited to, tissue plasminogen activator (t-PA), interferon, interleukin, growth hormone, histocompatibility and viral envelope glycoprotein signal segments. Suitable fusion segments encoded by fusion segment nucleic acids are disclosed herein. In addition, a nucleic acid molecule of the present invention can be joined to a fusion segment that directs the encoded protein to the proteosome, such as a ubiquitin fusion segment. Eukaryotic recombinant molecules may also include intervening and/or untranslated sequences surrounding and/or within the nucleic acid sequences of nucleic acid molecules of the present invention.

Another embodiment of the present invention includes a recombinant cell comprising a host cell transformed with one or more recombinant molecules of the present invention. Transformation of a nucleic acid molecule into a cell can be accomplished by any method by which a nucleic acid molecule can be inserted into the cell. Transformation techniques include, but are not limited to, transfection, electroporation, microinjection, lipofection, adsorption, and protoplast fusion. A recombinant cell may remain unicellular or may grow into a tissue, organ or a multicellular organism. It is to be noted that a cell line refers to any recombinant cell of the present invention that is not a transgenic animal. Transformed nucleic acid molecules of the present invention can remain extrachromosomal or can integrate into one or more sites within a chromosome of the transformed (i.e., recombinant) cell in such a manner that their ability to be expressed is retained. Preferred nucleic acid molecules with which to transform a cell include *C. felis* HMT and HNC nucleic acid molecules disclosed herein. Preferred nucleic acid molecules with which to transform a cell include nucleic acid molecules having a sequence of Table I, Table II, Table III and/or Table IV. Particularly preferred nucleic acid molecules with which to transform a cell include $nCfALN_{2057}$, $nCfALN_{1152}$, $nCfCBP_{1128}$, $nCfCBP_{816}$, $nCfNKAB_{1714}$, $nCfNKAB_{978}$ $nCfLGIC_{2240}$, $nCfLGIC_{1707}$, $nCfANON_{1429}$, $nCfANON_{1194}$, $nCfMALV_{765}$, $nCfMALV_{762}$, $nCfOSD_{604}$, $nCfOSD_{405}$, $nCfNMDA_{1227}$, $nCfNMDA_{738}$, $nCfCLBP1A_{633}$, $nCfCLBP1A_{441}$, $nCfCLBP2A_{631}$, $nCfCLBP2A_{441}$, $nCfLGIC_{2739}$, $nCfLGIC_{2016}$, $nCfNAH_{2080}$, $nCfNAH_{1824}$, $nCfCLIC_{2283}$, $nCfCLIC_{786}$, $nCfPL2_{1291}$, $nCfPL2_{1173}$, $nCfPL3_{406}$, $nCfPL3_{243}$, $nCfPL4_{974}$, $nCfPL4_{1043}$, $nCfPL4_{1062}$, $nCfPL4_{855}$, $nCfSVP_{1875}$, $nCfSVP_{1590}$, $nCfVGCC_{381}$, $nCfVGCC_{2191}$, $nCfVGCC_{1968}$, $nCfVGCC_{673}$, $nCfVGCC_{3126}$, $nCfVGCC_{2553}$, $nCfAUP_{1181}$, $nCfAUP_{306}$, $nCf7B2_{2161}$, $nCf7B2_{801}$, or $nCf7B2_{741}$.

Suitable host cells to transform include any cell that can be transformed with a nucleic acid molecule of the present invention. Host cells can be either untransformed cells or cells that are already transformed with at least one nucleic acid molecule (e.g., nucleic acid molecules encoding one or more proteins of the present invention and/or other proteins useful in the production of multivalent vaccines). Host cells of the present invention either can be endogenously (i.e., naturally) capable of producing flea HMT and/or HNC proteins of the present invention or can be capable of producing such proteins after being transformed with at least one nucleic acid molecule of the present invention. Host cells of the present invention can be any cell capable of producing at least one protein of the present invention, and include bacterial, fungal (including yeast), parasite (including helminth, protozoa and ectoparasite), other insect, other animal and plant cells. Preferred host cells include bacterial, mycobacterial, yeast, insect and mammalian cells. More preferred host cells include *Salmonella, Escherichia, Bacillus, Caulobacter, Listeria, Saccharomyces, Pichia, Spodoptera, Mycobacteria, Trichoplusia*, BHK (baby hamster kidney) cells, MDCK cells (Madin-Darby canine kidney cell line), CRFK cells (Crandell feline kidney cell line), CV-1 cells (African monkey kidney cell line used, for example, to culture raccoon poxvirus), COS (e.g., COS-7) cells, and Vero cells. Particularly preferred host cells are *Escherichia coli*, including *E. coli* K-12 derivatives; *Salmonella typhi; Salmonella typhimurium*, including attenuated strains such as UK-1 $\chi 3987$ and SR-11 $\chi^{4072}$; *Caulobacter; Pichia; Spodoptera frugiperda; Trichoplusia ni*; BHK cells; MDCK cells; CRFK cells; CV-1 cells; COS cells; Vero cells; and non-tumorigenic mouse myoblast G8 cells (e.g., ATCC CRL 1246). Additional appropriate mammalian cell hosts include other kidney cell lines, other fibroblast cell lines (e.g., human, murine or chicken embryo fibroblast cell lines), myeloma cell lines, Chinese hamster ovary cells, mouse NIH/3T3 cells, LMTK$^{31}$ cells and/or HeLa cells. In one embodiment, the proteins may be expressed as heterologous proteins in myeloma cell lines employing immunoglobulin promoters.

A recombinant cell is preferably produced by transforming a host cell with one or more recombinant molecules, each comprising one or more nucleic acid molecules of the present invention operatively linked to an expression vector containing one or more transcription control sequences, examples of which are disclosed herein. The phrase operatively linked refers to insertion of a nucleic acid molecule into an expression vector in a manner such that the molecule is able to be expressed when transformed into a host cell.

A recombinant cell of the present invention includes any cell transformed with at least one of any nucleic acid molecule of the present invention. Suitable and preferred nucleic acid molecules as well as suitable and preferred recombinant molecules with which to transfer cells are disclosed herein.

Recombinant cells of the present invention can also be co-transformed with one or more recombinant molecules including flea HMT and/or HNC nucleic acid molecules encoding one or more proteins of the present invention and one or more other nucleic acid molecules encoding other protective compounds, as disclosed herein (e.g., to produce multivalent vaccines).

Recombinant DNA technologies can be used to improve expression of transformed nucleic acid molecules by manipulating, for example, the number of copies of the nucleic acid molecules within a host cell, the efficiency with which those nucleic acid molecules are transcribed, the efficiency with which the resultant transcripts are translated, and the efficiency of post-translational modifications. Recombinant techniques useful for increasing the expression of nucleic acid molecules of the present invention include, but are not limited to, operatively linking nucleic acid molecules to high-copy number plasmids, integration of the nucleic acid molecules into one or more host cell chromosomes, addition of vector stability sequences to plasmids, substitutions or modifications of transcription control signals (e.g., promoters, operators, enhancers), substitutions or modifications of translational control signals (e.g., ribosome binding sites, Shine-Dalgamo sequences), modification of nucleic acid molecules of the present invention to correspond to the codon usage of the host cell, deletion of sequences that destabilize transcripts, and use of control signals that temporally separate recombinant cell growth from recombinant enzyme production during fermentation. The activity of an expressed recombinant protein of the present invention may be improved by fragmenting, modifying, or derivatizing nucleic acid molecules encoding such a protein.

Isolated flea HMT and/or HNC proteins of the present invention can be produced in a variety of ways, including production and recovery of natural proteins, production and recovery of recombinant proteins, and chemical synthesis of the proteins. In one embodiment, an isolated protein of the present invention is produced by culturing a cell capable of expressing the protein under conditions effective to produce the protein, and recovering the protein. A preferred cell to culture is a recombinant cell of the present invention. Effective culture conditions include, but are not limited to, effective media, bioreactor, temperature, pH and oxygen conditions that permit protein production. An effective medium refers to any medium in which a cell is cultured to produce a flea HMT and/or HNC protein of the present invention. Such medium typically comprises an aqueous medium having assimilable carbon, nitrogen and phosphate sources, and appropriate salts, minerals, metals and other nutrients, such as vitamins. Cells of the present invention can be cultured in conventional fermentation bioreactors, shake flasks, test tubes, microtiter dishes, and petri plates. Culturing can be carried out at a temperature, pH and oxygen content appropriate for a recombinant cell. Such culturing conditions are within the expertise of one of ordinary skill in the art. Examples of suitable conditions are included in the Examples section.

Depending on the vector and host system used for production, resultant proteins of the present invention may either remain within the recombinant cell; be secreted into the fermentation medium; be secreted into a space between two cellular membranes, such as the periplasmic space in *E. coli*; or be retained on the outer surface of a cell or viral membrane.

The phrase "recovering the protein", as well as similar phrases, refers to collecting the whole fermentation medium containing the protein and need not imply additional steps of separation or purification. Proteins of the present invention can be purified using a variety of standard protein purification techniques, such as, but not limited to, affinity chromatography, ion exchange chromatography, filtration, electrophoresis, hydrophobic interaction chromatography, gel filtration chromatography, reverse phase chromatography, concanavalin A chromatography, chromatofocusing and differential solubilization. Proteins of the present invention are preferably retrieved in "substantially pure" form. As used herein, "substantially pure" refers to a purity that allows for the effective use of the protein as a therapeutic composition or diagnostic. A therapeutic composition for animals, for example, should exhibit no substantial toxicity and preferably should be capable of stimulating the production of antibodies in a treated animal.

The present invention also includes isolated (i.e., removed from their natural milieu) antibodies that selectively bind to a flea HMT and/or HNC protein of the present invention or a mimetope thereof (e.g., anti-*C. felis* HMT or HNC antibodies). As used herein, the term "selectively binds to" an HMT and/or HNC protein refers to the ability of antibodies of the present invention to preferentially bind to specified proteins and mimetopes thereof of the present invention. Binding can be measured using a variety of methods standard in the art including enzyme immunoassays (e.g., ELISA), immunoblot assays, etc.; see, for example, Sambrook et al., ibid., and Harlow, et al., 1988, Antibodies, a Laboratory Manual, Cold Spring Harbor Labs Press; Harlow et al., ibid., is incorporated by reference herein in its entirety. An anti-HMT or anti-HNC antibody of the present invention preferably selectively binds to a flea HMT or HNC protein respectively in such a way as to inhibit the function of that protein.

Isolated antibodies of the present invention can include antibodies in serum, or antibodies that have been purified to varying degrees. Antibodies of the present invention can be polyclonal or monoclonal, or can be functional equivalents such as antibody fragments and genetically-engineered antibodies, including single chain antibodies or chimeric antibodies that can bind to one or more epitopes.

A preferred method to produce antibodies of the present invention includes (a) administering to an animal an effective amount of a protein, peptide or mimetope thereof of the present invention to produce the antibodies and (b) recovering the antibodies. In another method, antibodies of the present invention are produced recombinantly using techniques as heretofore disclosed to produce HMT and/or HNC proteins of the present invention. Antibodies raised against defined proteins or mimetopes can be advantageous because such antibodies are not substantially contaminated with antibodies against other substances that might otherwise cause interference in a diagnostic assay or side effects if used in a therapeutic composition.

Antibodies of the present invention have a variety of potential uses that are within the scope of the present invention. For example, such antibodies can be used (a) as therapeutic compounds to passively immunize an animal in order to protect the animal from fleas susceptible to treatment by such antibodies and/or (b) as tools to screen expression libraries and/or to recover desired proteins of the present invention from a mixture of proteins and other contaminants. Furthermore, antibodies of the present invention can be used to target cytotoxic agents to fleas in order to directly kill such fleas. Targeting can be accomplished by conjugating (i.e., stably joining) such antibodies to the cytotoxic agents using techniques known to those skilled in the art. Suitable cytotoxic agents are known to those skilled in the art.

One embodiment of the present invention is a therapeutic composition that, when administered to an animal susceptible to flea infestation, is capable of protecting that animal from flea infestation. Therapeutic compositions of the present invention include at least one of the following protective molecules: an isolated flea HMT and/or HNC protein; a mimetope of an isolated flea HMT and/or HNC protein; an isolated flea HMT and/or HNC nucleic acid molecule; and/or a compound derived from said isolated flea HMT and/or HNC protein that inhibits HMT and/or HNC protein activity. A therapeutic composition of the present invention can further comprise a component selected from the group of an excipient, a carrier, and/or an adjuvant; these components are described further herein. As used herein, a protective molecule or protective compound refers to a compound that, when administered to an animal in an effective manner, is able to treat, ameliorate, and/or prevent flea infestation. Preferred fleas to target are heretofore disclosed. One example of a protective molecule is a vaccine, such as, but not limited to, a naked nucleic acid vaccine, a recombinant virus vaccine, a recombinant cell vaccine, and a recombinant protein vaccine. Another example of a protective molecule is a compound that inhibits HMT and/or HNC protein activity, such as an isolated antibody that selectively binds to a flea HMT and/or HNC protein, a substrate analog of a flea HMT and/or HNC protein, anti-sense-, triplex formation-, ribozyme-, and/or RNA drug-based compounds, or other inorganic or organic molecules that inhibit HMT and/or HNC protein activity. Inhibiting flea HMT and/or HNC protein activity can refer to the ability of a compound to reduce the activity of flea HMT and/or HNC proteins. Inhibiting flea HMT and/or HNC protein activity can also refer to the ability of a compound to reduce the amount of flea HMT and/or HNC protein in a flea.

Another embodiment of the present invention includes a method to reduce a flea infestation in an animal susceptible to flea infestation. Such a method includes the step of administering to the animal a therapeutic molecule comprising a protective compound selected from the group consisting of (a) an isolated flea HMT and/or HNC protein; (b) a mimetope of an isolated flea HMT and/or HNC protein; (c) an isolated flea HMT and/or HNC nucleic acid molecule; and (d) a compound derived from an isolated flea HMT and/or HNC protein that inhibits HMT and/or HNC protein activity.

Therapeutic compositions of the present invention can be administered to any animal susceptible to flea infestation, preferably to mammals, and more preferably to dogs, cats, humans, ferrets, horses, cattle, sheep, and other pets, economic food animals, work animals and/or zoo animals. Preferred animals to protect against flea infestation include dogs, cats, humans, and ferrets, with dogs and cats being particularly preferred.

As used herein, the term derived, or the term derived from, refers to a peptide, antibody, mimetope, nucleic acid molecule, or other compound that was obtained from a flea HMT and/or HNC protein or nucleic acid molecule of the present invention. Methods to obtain derivatives from a HMT and/or HNC molecule of the present invention are known in the art, and as such include, but are not limited to, molecular modeling of HMT and/or HNC proteins to determine active sites, i.e. sites that interact with other molecules, and predicting from these active sites smaller fragments and/or mimetopes that retain and/or mimic these active sites, thereby inhibiting HMT and/or HNC protein activity; screening of peptide or small chemical compound libraries against HMT and/or HNC proteins of the present invention; and screening of polyclonal or monoclonal antibodies to find antibodies that specifically bind HMT and/or HNC proteins of the present invention.

A HMT and/or HNC protein inhibitor of the present invention is identified by its ability to bind to, modify, or otherwise interact with, a flea HMT and/or HNC protein, thereby inhibiting the activity of HMT and/or HNC proteins. Suitable inhibitors of HMT and/or HNC protein activity are compounds that inhibit HMT and/or HNC protein activity in at least one of a variety of ways: (a) by binding to or otherwise interacting with or otherwise modifying HMT and/or HNC protein sites; (b) by binding to or otherwise interacting with or otherwise modifying the HMT and/or HNC protein active site; (c) by binding to the HMT and/or HNC protein and thus reducing the availability of the HMT and/or HNC protein in solution; and (d) by interacting with other regions of the HMT and/or HNC protein to inhibit HMT and/or HNC protein activity, for example, by allosteric interaction.

Flea HMT and/or HNC protein inhibitors can be used directly as compounds in compositions of the present invention to treat animals as long as such compounds are not harmful to host animals being treated. Preferred HMT and/or HNC protein inhibitors of the present invention include, but are not limited to, flea HMT and/or HNC protein substrate analogs, and other molecules that bind to a flea HMT and/or HNC proteins (e.g., to an allosteric site) in such a manner that the activity of the flea HMT and/or HNC protein is inhibited. A HMT and/or HNC protein substrate analog refers to a compound that interacts with (e.g., binds to, associates with, modifies) the active site of a HMT and/or HNC protein. A preferred HMT and/or HNC protein substrate analog inhibits HMT and/or HNC protein activity. HMT and/or HNC protein substrate analogs can be of any inorganic or organic composition. HMT and/or HNC protein substrate analogs can be, but need not be, structurally similar to a HMT and/or HNC protein natural substrate as long as they can interact with the active site of that HMT and/or HNC protein. HMT and/or HNC protein substrate analogs can be designed using computer-generated structures of HMT and/or HNC proteins of the present invention or computer structures of HMT and/or HNC protein's natural substrates. Preferred sites to model include one or more of the active sites of HMT and/or HNC protein. Substrate analogs can also be obtained by generating random samples of molecules, such as oligonucleotides, peptides, peptidomimetic compounds, or other inorganic or organic molecules, and screening such samples for their ability to interfere with interaction between HMT and/or HNC proteins and their substrates, e.g. by affinity chromatography techniques. A preferred HMT and/or HNC protein substrate analog is a HMT and/or HNC protein mimetic compound, i.e., a compound that is structurally and/or functionally similar to a natural substrate of a HMT and/or HNC protein of the present invention, particularly to the region of the substrate that interacts with the HMT and/or HNC protein active site, but that inhibits HMT and/or HNC protein activity upon interacting with the HMT and/or HNC protein active site.

The present invention also includes a therapeutic composition comprising at least one protective molecule of the present invention in combination with at least one additional compound protective against one or more infectious agents.

In one embodiment, a therapeutic composition of the present invention can be used to protect an animal from flea infestation by administering such composition to a flea in order to prevent infestation. Such administration to the flea and/or animal could be oral, or by application to the animal's body surface (e.g. topical spot-on, or spraying onto the animal), or by application to the environment (e.g., spraying). Examples of such compositions include, but are not limited to, transgenic vectors capable of producing at least one therapeutic composition of the present invention. In another embodiment a flea can ingest therapeutic compositions, or products thereof, present on the surface of or in the blood of a host animal that has been administered a therapeutic composition of the present invention.

In accordance with the present invention, a host animal (i.e., an animal that is or is capable of being infested with fleas) is treated by administering to the animal a therapeutic composition of the present invention in such a manner that the composition itself (e.g., a HMT and/or HNC protein inhibitor, a HMT and/or HNC protein synthesis suppressor (i.e., a compound that decreases the production or half-life of a HMT and/or HNC protein in fleas), a HMT and/or HNC protein mimetope, or a anti-HMT and/or HNC antibody) or a product generated by the animal in response to administration of the composition (e.g., antibodies produced in response to administration of a flea HMT and/or HNC protein or nucleic acid molecule, or conversion of an inactive inhibitor "prodrug" to an active HMT and/or HNC protein inhibitor) ultimately enters the flea. A host animal is preferably treated in such a way that the compound or product thereof is present on the body surface of the animal or enters the blood stream of the animal. Fleas are then exposed to the composition or product when they feed from the animal. For example, flea HMT and/or HNC protein inhibitors administered to an animal are administered in such a way that the inhibitors enter the blood stream of the animal, where they can be taken up by feeding fleas.

The present invention also includes the ability to reduce larval flea infestation in that when fleas feed from a host animal that has been administered a therapeutic composition of the present invention, at least a portion of compounds of the present invention, or products thereof, in the blood taken up by the fleas are excreted by the fleas in feces, which is subsequently ingested by flea larvae. In particular, it is of note that flea larvae obtain most, if not all, of their nutrition from flea feces.

In accordance with the present invention, reducing HMT and/or HNC protein activity in a flea can lead to a number of outcomes that reduce flea burden on treated animals and their surrounding environments. Such outcomes include, but are not limited to, (a) reducing the viability of fleas that feed from the treated animal, (b) reducing the fecundity of female fleas that feed from the treated animal, (c) reducing the reproductive capacity of male fleas that feed from the treated animal, (d) reducing the viability of eggs laid by female fleas that feed from the treated animal, (e) altering the blood feeding behavior of fleas that feed from the treated animal (e.g., fleas take up less volume per feeding or feed less frequently), (f) reducing the viability of flea larvae, for example due to the feeding of larvae from feces of fleas that feed from the treated animal, (g) altering the development of flea larvae (e.g., by decreasing feeding behavior, inhibiting growth, inhibiting (e.g., slowing or blocking) molting, and/or otherwise inhibiting maturation to adults), and/or (h) altering or decreasing the ability of fleas or flea larvae to digest a blood meal.

In order to protect an animal from flea infestation, a therapeutic composition of the present invention is administered to the animal in an effective manner such that the composition is capable of protecting that animal from flea infestation. Therapeutic compositions of the present invention can be administered to animals prior to infestation in order to prevent infestation (i.e., as a preventative vaccine) and/or can be administered to animals after infestation. For example, proteins, mimetopes thereof, and antibodies thereof can be used as immunotherapeutic agents.

Therapeutic compositions of the present invention can be formulated in an excipient that the animal to be treated can tolerate. Examples of such excipients include water, saline, Ringer's solution, dextrose solution, Hank's solution, and other aqueous physiologically balanced salt solutions. Non-aqueous vehicles, such as fixed oils, sesame oil, ethyl oleate, or triglycerides may also be used. Other useful formulations include suspensions containing viscosity enhancing agents, such as sodium carboxymethylcellulose, sorbitol, or dextran. Excipients can also contain minor amounts of additives, such as substances that enhance isotonicity and chemical stability. Examples of buffers include phosphate buffer, bicarbonate buffer and Tris buffer, while examples of preservatives include thimerosal, or o-cresol, formalin and benzyl alcohol. Standard formulations can either be liquid injectables or solids which can be taken up in a suitable liquid as a suspension or solution for injection. Thus, in a non-liquid formulation, the excipient can comprise dextrose, human serum albumin, preservatives, etc., to which sterile water or saline can be added prior to administration.

In one embodiment of the present invention, a therapeutic composition can include an adjuvant. Adjuvants are agents that are capable of enhancing the immune response of an animal to a specific antigen. Suitable adjuvants include, but are not limited to, cytokines, chemokines, and compounds that induce the production of cytokines and chemokines (e.g., granulocyte macrophage colony stimulating factor (GM-CSF), Flt-3 ligand, granulocyte colony stimulating factor (G-CSF), macrophage colony stimulating factor (M-CSF), colony stimulating factor (CSF), erythropoietin (EPO), interleukin 2 (IL-2), interleukin-3 (IL-3), interleukin 4 (IL-4), interleukin 5 (IL-5), interleukin 6 (IL-6), interleukin 7 (IL-7), interleukin 8 (IL-8), interleukin 10 (IL-10), interleukin 12 (IL-12), interferon gamma, interferon gamma inducing factor I (IGIF), transforming growth factor beta, RANTES (regulated upon activation, normal T cell expressed and presumably secreted), macrophage inflammatory proteins (e.g., MIP-1 alpha and MIP-1 beta), and *Leishmania* elongation initiating factor (LEIF)); bacterial components (e.g., endotoxins, in particular superantigens, exotoxins and cell wall components); aluminum-based salts; calcium-based salts; silica; polynucleotides; toxoids; serum proteins, viral coat proteins; block copolymer adjuvants (e.g., Hunter's Titermax™ adjuvant (Vaxcel™, Inc. Norcross, Ga.), Ribi adjuvants (Ribi ImmunoChem Research, Inc., Hamilton, Mont.); and saponins and their derivatives (e.g., Quil A (Superfos Biosector A/S, Denmark). Protein adjuvants of the present invention can be delivered in the form of the protein themselves or of nucleic acid molecules encoding such proteins using the methods described herein.

In one embodiment of the present invention, a therapeutic composition can include a carrier. Carriers include compounds that increase the half-life of a therapeutic composition in the treated animal. Suitable carriers include, but are not limited to, polymeric controlled release vehicles, biodegradable implants, liposomes, bacteria, viruses, other cells, oils, esters, and glycols.

One embodiment of the present invention is a controlled release formulation that is capable of slowly releasing a composition of the present invention into an animal. As used herein, a controlled release formulation comprises a composition of the present invention in a controlled release vehicle. Suitable controlled release vehicles include, but are not limited to, biocompatible polymers, other polymeric matrices, capsules, microcapsules, microparticles, bolus preparations, osmotic pumps, diffusion devices, liposomes, lipospheres, and transdermal delivery systems. Other controlled release formulations of the present invention include liquids that, upon administration to an animal, form a solid or a gel in situ. Preferred controlled release formulations are biodegradable (i.e., bioerodible).

A preferred controlled release formulation of the present invention is capable of releasing a composition of the present invention into the blood of the treated animal at a constant rate sufficient to attain therapeutic dose levels of the composition to protect an animal from flea infestation. The therapeutic composition is preferably released over a period of time ranging from about 1 to about 12 months. A controlled release formulation of the present invention is capable of effecting a treatment preferably for at least about 1 month, more preferably for at least about 3 months, even more preferably for at least about 6 months, even more preferably for at least about 9 months, and even more preferably for at least about 12 months.

Acceptable protocols to administer therapeutic compositions in an effective manner include individual dose size, number of doses, frequency of dose administration, and mode of administration. Determination of such protocols can be accomplished by those skilled in the art. A suitable single dose is a dose that is capable of protecting an animal from disease when administered one or more times over a suitable time period. For example, a preferred single dose of a protein, mimetope or antibody therapeutic composition, including a recombinant protein vaccine, is from about 1 microgram (µg) to about 10 milligrams (mg) of the therapeutic composition per kilogram body weight of the animal. Booster vaccinations can be administered from about 2 weeks to several years after the original administration. Booster administrations preferably are administered when the immune response of the animal becomes insufficient to protect the animal from disease. A preferred administration schedule is one in which from about 10 µg to about 1 mg of the therapeutic composition per kg body weight of the animal is administered from about one to about two times over a time period of from about 2 weeks to about 12 months. Modes of administration can include, but are not limited to, subcutaneous, intradermal, intravenous, intranasal, oral, transdermal, intraocular, intranasal, conjunctival, and intramuscular routes. Methods of administration for other therapeutic compounds can be determined by one skilled in the art, and may include administration of a therapeutic composition one or more times, on a daily, weekly, monthly or yearly regimen; routes of administration can be determined by one skilled in the art, and may include any route. A preferred route of administration of an inhibitory compound when administering to fleas is a topical, or "spot-on" formulation administered to the body surface of the animal, so that a flea would encounter the inhibitory compound when attached to the animal; another preferred route of administration of an inhibitory compound is an oral formulation that, when fed to an animal, would enter the bloodstream of the animal, which would then be transferred to a flea while feeding from the animal.

A recombinant protein vaccine of the present invention comprises a recombinantly-produced flea HMT and/or HNC protein of the present invention that is administered to an animal according to a protocol that results in the animal producing a sufficient immune response to protect itself from a flea infestation. Such protocols can be determined by those skilled in the art.

According to one embodiment, a nucleic acid molecule of the present invention can be administered to an animal in a fashion to enable expression of that nucleic acid molecule into a protective protein or protective RNA (e.g., antisense RNA, ribozyme, triple helix forms or RNA drug) in the animal. Nucleic acid molecules can be delivered to an animal in a variety of methods including, but not limited to, (a) administering a naked (i.e., not packaged in a viral coat or cellular membrane) nucleic acid as a genetic vaccine (e.g., as naked DNA or RNA molecules, such as is taught, for example in Wolff et al., 1990, *Science* 247, 1465-1468) or (b) administering a nucleic acid molecule packaged as a recombinant virus vaccine or as a recombinant cell vaccine (i.e., the nucleic acid molecule is delivered by a viral or cellular vehicle).

A genetic (i.e., naked nucleic acid) vaccine of the present invention includes a nucleic acid molecule of the present invention and preferably includes a recombinant molecule of the present invention that preferably is replication, or otherwise amplification, competent. A genetic vaccine of the present invention can comprise one or more nucleic acid molecules of the present invention in the form of, for example, a dicistronic recombinant molecule. Preferred genetic vaccines include at least a portion of a viral genome, i.e., a viral vector. Preferred viral vectors include those based on alphaviruses, poxviruses, adenoviruses, herpesviruses, picornaviruses, and retroviruses, with those based on alphaviruses, such as sindbis or Semliki forest virus, species-specific herpesviruses and poxviruses being particularly preferred. Any suitable transcription control sequence can be used, including those disclosed as suitable for protein production. Particularly preferred transcription control sequences include cytomegalovirus immediate early (preferably in conjunction with Intron-A), Rous sarcoma virus long terminal repeat, and tissue-specific transcription control sequences, as well as transcription control sequences endogenous to viral vectors if viral vectors are used. The incorporation of a "strong" polyadenylation signal is also preferred.

Genetic vaccines of the present invention can be administered in a variety of ways, with intramuscular, subcutaneous, intradermal, transdermal, conjunctival, intraocular, intranasal and oral routes of administration being preferred. A preferred single dose of a genetic vaccine ranges from about 1 nanogram (ng) to about 600 µg, depending on the route of administration and/or method of delivery, as can be determined by those skilled in the art. Suitable delivery methods include, for example, by injection, as drops, aerosolized and/or topically. Genetic vaccines of the present invention can be contained in an aqueous excipient (e.g., phosphate buffered saline) alone or in a carrier (e.g., lipid-based vehicles).

A recombinant virus vaccine of the present invention includes a recombinant molecule of the present invention that is packaged in a viral coat and that can be expressed in an animal after administration. Preferably, the recombinant molecule is packaging- or replication-deficient and/or encodes an attenuated virus. A number of recombinant viruses can be used, including, but not limited to, those based on alphaviruses, poxviruses, adenoviruses, herpesviruses, picornaviruses, and retroviruses. Preferred recombinant virus vaccines are those based on alphaviruses (such as Sindbis virus), raccoon poxviruses, species-specific herpesviruses and species-specific poxviruses. An example of methods to produce and use alphavirus recombinant virus vaccines are disclosed in U.S. Pat. No. 5,766,602 to Xiong and Grieve, which is incorporated by reference herein in its entirety.

When administered to an animal, a recombinant virus vaccine of the present invention infects cells within the immunized animal and directs the production of a protective protein or RNA nucleic acid molecule that is capable of protecting the animal from flea infestation as disclosed herein. For example, a recombinant virus vaccine comprising a flea HMT and/or HNC nucleic acid molecule of the present invention is administered according to a protocol that results in the animal producing a sufficient immune response to protect itself from flea infestation. A preferred single dose of a recombinant virus vaccine of the present invention is from about $1\times10^4$ to about $1\times10^8$ virus plaque forming units (pfu) per kilogram body weight of the animal. Administration protocols are similar to those described herein for protein-based vaccines, with subcutaneous, intramuscular, intranasal, intraocular, conjunctival, and oral administration routes being preferred.

A recombinant cell vaccine of the present invention includes recombinant cells of the present invention that express at least one protein of the present invention. Preferred recombinant cells for this embodiment include *Salmonella, E. coli, Listeria, Mycobacterium, S. frugiperda*, yeast, (including *Saccharomyces cerevisiae* and *Pichia pastoris*), BHK, CV-1, myoblast G8, COS (e.g., COS-7), Vero, MDCK and CRFK recombinant cells. Recombinant cell vaccines of the present invention can be administered in a variety of ways but have the advantage that they can be administered orally, preferably at doses ranging from about $10^8$ to about $10^{12}$ cells per kilogram body weight. Administration protocols are similar to those described herein for protein-based vaccines. Recombinant cell vaccines can comprise whole cells, cells stripped of cell walls or cell lysates.

The efficacy of a therapeutic composition of the present invention to protect an animal from flea infestation can be tested in a variety of ways including, but not limited to, detection of protective antibodies (using, for example, proteins or mimetopes of the present invention), detection of cellular immunity within the treated animal, or challenge of the treated animal with the fleas to determine whether the treated animal is resistant to infestation. Challenge studies can include direct administration of fleas to the treated animal. In one embodiment, therapeutic compositions can be tested in animal models such as mice. Such techniques are known to those skilled in the art.

One therapeutic composition of the present invention includes an inhibitor of flea HMT and/or HNC protein activity, i.e., a compound capable of substantially interfering with the function of a flea HMT and/or HNC protein susceptible to inhibition by an inhibitor of flea HMT and/or HNC protein activity. An inhibitor of HMT and/or HNC protein activity can be identified using flea HMT and/or HNC proteins of the present invention. An inhibitor of HMT and/or HNC protein function can be identified using flea HMT and/or HNC proteins of the present invention. A preferred inhibitor of HMT and/or HNC protein function is a compound capable of substantially interfering with the function of a flea HMT and/or HNC protein and which does not substantially interfere with host animal proteins. As used herein, a compound that does not substantially inhibit or interfere with host animal proteins is one that, when administered to a host animal, the host animal shows no significant adverse effects attributable to the compound and which, when administered to an animal in an effective manner, is capable of protecting that animal from flea infestation.

One embodiment of the present invention is a method to identify a compound capable of inhibiting HMT and/or HNC protein activity of a flea. Such a method includes the steps of (a) contacting (e.g., combining, mixing) an isolated flea HMT and/or HNC protein, preferably a *C. felis* HMT and/or HNC protein of the present invention, with a putative inhibitory compound under conditions in which, in the absence of the compound, the protein has HMT and/or HNC protein activity, and (b) determining if the putative inhibitory compound inhibits the activity. HMT and/or HNC protein activity can be determined in a variety of ways known in the art, including but not limited to determining the ability of HMT and/or HNC protein to bind to or otherwise interact with a substrate. Such conditions under which a HMT and/or HNC protein has HMT and/or HNC protein activity include conditions in which a HMT and/or HNC protein has a correct three-dimensionally folded structure under physiologic conditions, i.e. physiologic pH, physiologic ionic concentrations, and physiologic temperatures.

Putative inhibitory compounds to screen include antibodies (including fragments and mimetopes thereof), putative substrate analogs, and other, preferably small, organic or inorganic molecules. Methods to determine HMT and/or HNC protein activity are known to those skilled in the art; see, for example, the Examples section of the present application. Methods to determine binding of a putative inhibitory compound to a HMT and/or HNC protein of the present invention are known to those of skill in the art and include, for example, determining changes in molecular mass using surface plasmon resonance (e.g., determining light scatter by an inhibitor of a HMT and/or HNC protein, before and after contacting the inhibitor or protein with a HMT and/or HNC protein or inhibitor, respectively) or screening for compounds that inhibit interaction between a HMT and/or HNC protein and a substrate.

A preferred method to identify a compound capable of inhibiting HMT and/or HNC protein activity includes contacting an isolated flea HMT and/or HNC protein having an amino acid sequence selected from the group consisting of: (a) a protein comprising an amino acid sequence selected from the group consisting of SEQ ID NO:2, SEQ ID NO:8, SEQ ID NO:14, SEQ ID NO:20, SEQ ID NO:26, SEQ ID NO:32, SEQ ID NO:38, SEQ ID NO:44, SEQ ID NO:154, SEQ ID NO:160, SEQ ID NO:163, SEQ ID NO:169, SEQ ID NO:1862, SEQ ID NO:1868, SEQ ID NO:1873, SEQ ID NO:1879, SEQ ID NO:1883, SEQ ID NO:1888, SEQ ID NO:1897, SEQ ID NO:1902, SEQ ID NO:1915, SEQ ID NO:1920, SEQ ID NO:1925, and/or SEQ ID NO:1930, and/or a protein encoded by a nucleic acid molecule of Table I, Table II, Table III and/or Table IV; (b) a protein comprising an at least 25 consecutive amino acid portion identical in sequence to a consecutive amino acid portion of a sequence as set forth in (a), wherein the protein has HMT and/or HNC protein activity; (c) a protein comprising a fragment of a protein as set forth in (a), wherein the fragment has an activity selected from the group consisting of binding to a HMT and/or HNC molecule and hydrolyzing a HMT and/or HNC protein substrate; and (d) a protein encoded by an allelic variant of a nucleic acid molecule that encodes any protein of (a), (b), or (c), with a putative inhibitory compound under conditions in which, in the absence of the compound, the protein has HMT and/or HNC protein activity; and determining if the putative inhibitory compound inhibits the activity.

Another embodiment of the present invention is an assay kit to identify an inhibitor of a flea HMT and/or HNC protein of the present invention. This kit comprises an isolated flea HMT and/or HNC protein of the present invention, and a means for determining inhibition of an activity of flea HMT and/or HNC protein, where the means enables detection of inhibition. Detection of inhibition of flea HMT and/or HNC protein identifies a putative inhibitor to be an inhibitor of flea HMT and/or HNC protein. Means for determining inhibition of flea HMT and/or HNC protein include an assay system that detects binding of a putative inhibitor to a flea HMT and/or HNC molecule, and an assay system that detects interference by a putative inhibitor of the ability of flea HMT and/or HNC protein to hydrolyze a substrate. Means and methods are described herein and are known to those skilled in the art.

The following examples are provided for the purposes of illustration and are not intended to limit the scope of the present invention. The following examples include a number of recombinant DNA and protein chemistry techniques known to those skilled in the art; see, for example, Sambrook et al., ibid.

EXAMPLE 1

This Example describes the isolation of RNA from the hindgut and Malpighian tubules (HMT) of *Ctenocephalides felis* and the use of isolated RNA to construct subtracted and unsubtracted cDNA libraries.

Approximately 10,000 hindguts and Malpighian tubules were dissected from equal numbers of cat blood fed and unfed adult *C. felis* with a male to female ratio of 1 to 4, and total RNA was extracted using a guanidine isothiocyanate lysis buffer and the standard procedure described by Sambrook et al. Poly-A enriched mRNA was purified from total RNA above using a mRNA Purification Kit, available from Pharmacia Biotech, Piscataway, N.J., following the manufacturer's protocol. The same procedures were used to extract total RNA and isolate poly-A enriched mRNA from the dissected *C. felis* bodies following removal of HMT, referred to hereinafter as "non-HMT mRNA".

Poly-A enriched mRNA was used to construct a cDNA library using subtractive hybridization and suppression PCR as follows. Subtractive hybridization and suppression PCR was conducted using a PCR-Select™ cDNA Subtraction Kit, available from Clontech Laboratories, Inc., Palo Alto, Calif. according to the manufacturer's instructions. Briefly, this kit uses subtractive hybridization and suppression PCR to specifically amplify cDNA sequences that are present in the tester cDNA and absent in the driver cDNA, thus enriching for tester-specific sequences. The efficiency of the subtraction process can be assessed by semi-quantitative PCR and by comparing the ethidium bromide staining patterns of the subtracted and unsubtracted samples on agarose gels as described in section V.D. of the manufacturer's protocol. For the semi-quantitative PCR, three genes with mRNAs known to be expressed outside of the HMT tissue were used to test for specific subtraction. These genes encoded putative actin, N-aminopeptidase, and serine protease proteins.

Subtractive hybridization and suppression PCR was conducted under the following conditions. Two micrograms (µg) of HMT mRNA was used as the template for synthesis of the tester material and 2 µg of non-HMT mRNA was used as template for synthesis of the driver material in this reaction. The number of cycles used in the selective amplification steps was optimized using the manufacturer's protocols. Optimization resulted in the use of 24 rather than the standard 27 cycles of primary PCR in combination with 15 cycles of secondary PCR rather than the standard 12 cycles.

The products from the suppressive PCR reaction were ligated into the pCR®2.1 vector, available from Invitrogen, Carlsbad, Calif., using an Original TA Cloning® Kit, available from Invitrogen. The ligation reaction was then used to transform INV αF' One Shot™ competent cells, available from Invitrogen, which were plated on Luria broth (LB) agar with 50 micrograms per milliliter (µg/ml) ampicillin, available from Sigma-Aldrich Co., St. Louis, Mo., and 50 µg/ml 5-bromo-4-chloro-3-indoyl β-D-galactopyranoside (X-Gal), available from Fisher Biotech, Fair Lawn, N.J. Transformed colonies were amplified and the DNA isolated using the standard alkaline lysis procedure described by Sambrook et al., ibid.

Automated cycle sequencing of DNA samples was performed using an ABI PRISM™ Model 377, available from Perkins Elmer, with XL upgrade DNA Sequencer, available from PE Applied Biosystems, Foster City, Calif., after reactions were carried out using the PRISM™ Dye Terminator Cycle Sequencing Ready Reaction Kit or the PRISM™ dRhodamine Terminator Cycle Sequencing Ready Reaction Kit or the PRISM™ BigDye™ Terminator Cycle sequencing Ready Reaction Kit, available from PE Applied Biosystems, following the manufacturer's protocol, hereinafter "standard sequencing methods". Sequence analysis was performed using the MacVector™ sequence analysis software, available from International Biotechnologies Inc., New Haven, Conn., and the Wisconsin Package Version 9.0 sequence analysis software, available from Genetics Computer Group (GCG), Madison, Wis., hereinafter referred to as GCG version 9.0, using default parameters. Each sequence read was trimmed of vector sequence at either end and submitted for a search through the National Center for Biotechnology Information (NCBI), National Library of Medicine, National Institute of Health, Baltimore, Md., using the BLAST network. This database includes SwissProt+PIR+ SPupdate+GenPept+GPUpdate+PDB databases. The search was conducted using the xBLAST function, which compares the translated sequences in all 6 reading frames to the protein sequences contained in the database. Clones with significant homology to sequences in the GenBank database were grouped according to proposed function and are listed in Table II. Clones with no significant homology to sequences in the GenBank database were searched manually for open reading frames and are listed in Table IV.

An unsubtracted HMT cDNA library was constructed as follows. Approximately 10,000 HMT tissues were dissected from equal numbers of unfed and cat blood-fed adult *C. felis* with a male to female ratio of 1:4. Total RNA was extracted using a guanidine isothiocyanate lysis buffer and procedures described in Sambrook et al., followed by isolation using a mRNA purification kit, available from Pharmacia, according to the manufacturer's protocols. The library was constructed with 5 µg of isolated mRNA using a ZAP-cDNA® cDNA synthesis kit, and packaged using a ZAP-cDNA® Gigapack® gold cloning kit, both available from Stratagene, La Jolla, Calif. The resultant HMT library was amplified to a titer of about $5 \times 10^9$ plaque forming units per milliliter (pfu/ml). Single clone excisions were performed using the Ex-Assist™ helper phage, available from Stratagene, and used to create double stranded plasmid template for sequencing using the manufacturer's protocols with the following exceptions. Following incubation of the SOLR cells with the cleared phage lysate, the mixture was used to inoculate LB broth, and the mix was incubated overnight and then subjected to mini-prep plasmid preparation and sequencing as described for the subtracted HMT library above.

EXAMPLE 2

This Example describes the isolation of RNA from the head and nerve cord (HNC) of *Ctenocephalides felis* and the use of isolated RNA to construct subtracted and unsubtracted cDNA libraries.

Approximately 4,000 heads and attached nerve cords, including the terminal abdominal ganglia were dissected from equal numbers of cat blood-fed and unfed adult *C. felis* with a male to female ratio of 1 to 4, and total RNA was extracted using a guanidine isothiocyanate lysis buffer and the standard procedure described by Sambrook et al. Approximately 618 µg of total RNA was recovered. Poly-A enriched mRNA was purified from total RNA above using a mRNA Purification Kit, available from Pharmacia, following the manufacturer's protocol. Approximately 13 µg of mRNA was isolated. The same procedures were used to extract total RNA and isolate poly-A enriched mRNA from the dissected *C. felis* bodies following removal of HNC tissues, referred to hereinafter as "non-HNC mRNA".

Suppression subtractive PCR was conducted as described in Example 1 using a PCR-Select™ cDNA Subtraction kit, available from Clontech, under the following conditions. Two micrograms (µg) of HNC mRNA was used as the template for synthesis of the tester material and 2 µg of non-HMT mRNA was used as template for synthesis of the driver material in this reaction. The number of cycles used in the selective amplification steps was optimized using the manufacturer's protocols. Optimization resulted in the use of 24 rather than the standard 27 cycles of primary PCR in combination with either 12 or 15 cycles of secondary PCR. cDNA pools from various PCR cycling combinations were ligated into the TA vector using a TA cloning kit, available from Invitrogen. Aliquots of ligation reaction were transformed into Ultramax DH5α™ bacteria, available from Gibco-BRL, Gaithersburg, Md. Portions of the transformation mixes were used to inoculate LB broth cultures containing 100 µg/ml of ampicillin. The overnight cultures were plated to generate discreet colonies which were used individually for overnight cultures for plasmid preps. Transformed colonies were amplified and the DNA isolated using the standard alkaline lysis procedure described by Sambrook et al., ibid.

Automated cycle sequencing of DNA samples was performed using the standard sequencing methods described in Example 1. Sequence analysis was performed using the MacVector™ sequence analysis software, available from International Biotechnologies Inc., New Haven, Conn., and the Wisconsin Package Version 9.0 sequence analysis software, available from Genetics Computer Group (GCG), Madison, Wis., hereinafter referred to as GCG version 9.0, using default parameters. Each sequence read was trimmed of vector sequence at either end and submitted for a xBLAST search as described in Example 1. Clones with significant homology to sequences in the GenBank database were grouped according to proposed function and are listed in Table I. Clones with no significant homology to sequences in the GenBank database were searched manually for open reading frames and are listed in Table III.

An unsubtracted cDNA library was constructed as follows. Approximately 6400 head and nerve cords were dissected from *C. felis* and poly-A RNA was isolated as described above. About seven µg of HNC poly-A RNA was used to construct a cDNA library using Stratagene's λZAP-cDNA Synthesis Kit and protocol. The resultant HNC library was amplified to a titer of about $5 \times 10^9$ plaque forming units per milliliter (pfu/ml). Single clone excisions were performed using the Ex-Assist helper phage, available from Stratagene, and used to create double stranded plasmid template for sequencing using the manufacturer's protocols with the following exceptions. Following incubation of the SOLR cells with the cleared phage lysate, the mixture was used to inoculate LB broth, and the mix was incubated overnight and then subjected to mini-prep plasmid preparation and sequencing as described for the subtracted library above.

EXAMPLE 3

This example describes the production of a *C. felis* cDNA pool by Rapid Amplification of cDNA Ends (RACE cDNA pool).

Total RNA was extracted from adult fed and unfed fleas as follows. Approximately 1000 adult fed fleas and 1000 adult unfed fleas were frozen on dry ice and separately ground into powder using a mortar and pestle and total RNA was extracted from each powder as follows. Ten ml of solution D (4 M guanidine isothiocyanate, 25 mM Sodium Citrate pH 7.0, 1.5% Sarcosyl, 0.5 M 2-mercaptoethanol) were added to the powder and the suspension was mixed by shaking. One ml of 2M sodium acetate, pH 4.0 and 3 ml of pH 4.7 phenol/chloroform/isoamyl alcohol (125:24:1), available from Sigma, were added and the suspension was mixed on a vortex shaker then incubated on ice for 15 minutes. Following incubation, the mixture was centrifuged at 10,000×g for 20 minutes and the supernatant was removed and extracted twice with pH 4.7 phenol/chloroform/isoamyl alcohol. Next, an equal volume of isopropanol was added to the supernatant and incubated at −20° C. for 2 hours followed by centrifugation at 10,000×g for 20 minutes. Following centrifugation, the supernatant was removed and discarded and the pellet was washed in 70% ethanol and allowed to dry at room temperature. The pellet was resuspended in 10 mM Tris 1 mM EDTA pH 8.0. Spectrophotometer analysis indicated that the yield of total RNA from unfed fleas was 1140 µg and the yield from fed fleas was 1500 µg.

Six-hundred µg from each of the fed and unfed adult flea total RNA extractions were combined and mRNA was then extracted using a mRNA Purification Kit, available from Amersham Pharmacia Biotech, Piscataway, N.J., using the manufacture's protocol. Approximately 15-25 µg of mRNA were isolated based on spectrophotometer analysis and ethidium bromide staining. One µg of purified mRNA was used as template to construct a RACE cDNA pool using a Marathon cDNA Amplification Kit, available from Clontech Laboratories, Inc., Palo Alto, Calif., according to the manufacture's instructions.

EXAMPLE 4

This example describes the cloning, sequencing, recombinant protein expression and purification of a *C. felis* allantoinase nucleic acid molecule of the present invention. This example also describes the expression of allantoinase mRNA in a variety of flea tissues.

A TA clone from the HMT EST library described in Example 1 was sequenced using standard sequencing methods and shown to have significant homology to allantoinase genes. This clone was digested with EcoRI to excise an insert 682 nucleotides in length, referred to as flea nucleic acid molecule $nCfALN_{682}$. The insert was isolated by gel purification using a Gel Purification kit, available from Qiagen, Chatsworth, Calif. Approximately 50 nanograms (ng) of purified $nCfALN_{682}$ was used to construct a $^{32}P$ α-dATP labeled DNA probe using a Megaprime DNA labeling kit, available from Amersham, Arlington Heights, Ill., using the manufacturer's protocols.

The $^{32}P$ α-dATP labeled probe was used in a standard plaque lift hybridization procedure to isolate a clone from the HMT lambda-ZAP unsubtracted cDNA library described in Example 1. The following hybridization conditions were used, hereinafter referred to as "standard hybridization conditions". Filters were hybridized with about $1 \times 10^6$ counts per minute (cpm) per ml of the probe in 5×SSPE, (see Sambrook et al., ibid.), 1.2% sodium dodecyl sulfate (SDS), 0.1 mg/mil salmon sperm DNA and 5× Denhardt's reagent, (see Sambrook et al., ibid.), at 55° C. for about 14 hours. The filters were washed as follows: (a) 10 minutes with 5×SSPE and 1% SDS, (b) 10 minutes with 2×SSPE and 1% SDS, (c) 10 minutes with 1×SSPE and 0.5% SDS, and (d) 10 minutes with 0.5×SSPE and 1% SDS. All washes were conducted at 55° C. Plaques that hybridized strongly to the probe were isolated and subjected to in vivo excision. In vivo excision was performed using the Stratagene Ex-Assist™ helper phage system and protocols, to convert a positive plaque to pBluescript™ plasmid DNA. Sequencing was conducted using standard sequencing methods following preparation of DNA with a Qiagen Qiaprep™ spin mini prep kit using the manufacturer's instructions and restriction enzyme digestion with about 1 µl of 20 U/µl each of EcoRI and XhoI, available from New England Biolabs, Beverly, Mass. A clone was isolated from a primary plaque, containing a nucleic acid molecule of about 2057 base pairs, referred to herein as $nCfALN_{2057}$, having a nucleotide sequence denoted herein as SEQ ID NO:1. The complement of SEQ ID NO:1 is represented herein as SEQ ID NO:3. Sequencing of $nCfALN_{682}$ indicates that $nCfALN_{682}$ shared 100% identity with nucleotides 855 through 1536 of SEQ ID NO:1.

Translation of SEQ ID NO:1 suggests that nucleic acid molecule $nCfALN_{2057}$ encodes a full-length allantoinase protein of 384 amino acids, referred to herein as $PCfALN_{384}$, having an amino acid sequence represented by SEQ ID NO:2, assuming the initiation codon spans from nucleotide 152 through nucleotide 154 of SEQ ID NO:1 and the termination codon spans from nucleotide 1304 through nucleotide 1306 of SEQ ID NO:1. The coding region encoding $PCfALN_{384}$, is represented by nucleic acid molecule $nCfALN_{1152}$, having a coding strand with the nucleic acid sequence represented by SEQ ID NO:4 and a complementary strand with nucleic acid sequence represented by SEQ ID NO:6. The amino acid sequence of $PCfALN_{384}$, also represented as SEQ ID NO:5, predicts that $PCfALN_{384}$ has an estimated molecular weight of about 42.2 kilodaltons (kDa) and an estimated isoelectric point (pI) of about 6.

Comparison of amino acid sequence SEQ ID NO:2 with amino acid sequences reported in GenBank indicates that SEQ ID NO:2 showed the most homology, i.e., about 48.6% identity, with a *Rana catesbeiana* (bullfrog) allantoinase protein, GenBank Accession No. 458126. Comparison of SEQ ID NO:4 with nucleic acid sequences reported in GenBank indicates that SEQ ID NO:4 showed the most homology, i.e., about 51% identity, with a *Rana catesbeiana* nucleic acid molecule, GenBank Accession number U03471. Percent identity calculations were performed using GCG version 9.0 using default parameters.

The coding region of $nCfALN_{2057}$, i.e. SEQ ID NO:4, was PCR amplified from the pBluescript™ clone described above as the template, using sense primer ALN-FE, having nucleotide sequence 5' GCG GAT CCT ATG CTG AAT TGC AAG AAC CTT G 3', having a BamHI site indicated in bold, designated herein as SEQ ID NO:37, and anti-sense primer ALN-RE, having nucleotide sequence 5' CAG GTA CCC TCT TTT AGA AGC ACC GGT CCC 3', having a KpnI site indicated in bold, designated herein as SEQ ID NO:38. PCR reactions were performed using the following amplification cycles: (a) one cycle at 95° C. for thirty seconds; (b) thirty cycles at 95° C. for twenty seconds, 50° C. for twenty seconds, and 72° C. for two minutes; and (c) one cycle at 72° C. for five minutes, hereinafter referred to as "standard thermocycling conditions", in reactions containing 2.5 mM $MgCl_2$, 0.2 mM dNTPs, 1 µM of each primer, 0.5 µl of 5U/µl Taq polymerase, 1 µl of 1 µg/µl template, and 3 µl of 10×Taq buffer, hereinafter referred to as "standard PCR reaction conditions". The PCR product was digested with BamHI and KpnI and ligated into the vector pTrcHisB, available from Invitrogen, that had been digested with BamHI and KpnI and treated with alkaline phosphatase. The resulting recombinant molecule, referred to herein as $pTrc-nCfALN_{1152}$, was transformed into *E. coli* strain BL21, available from Novagen Inc., Madison, Wis., to form recombinant cell *E. coli*:$pTrc-nCfALN_{1152}$.

The recombinant cell was grown under standard conditions and then incubated in the presence of 0.5 µM isopropylthio-β-galactoside (IPTG) to induce expression of recombinant protein, predicted to be approximately 42.2 kDa. Expression was confirmed using Coomassie-blue-stained Tris-glycine gel and by Western blot using a T7 tag antibody, available from Novagen, which showed expression of an about 55-kDa protein. The protein product was purified by liquid chromatography using a HiTrap™ chelating column charged with $NiCl_2$, available from Pharmacia, and was shown to contain the His tag of the vector when subjected to automated protein sequencing by Edman degradation.

A Northern Blot analysis was conducted as follows to determine whether allantoinase is expressed exclusively in HMT tissues. HMT tissues were dissected from 1000 adult cat blood-fed *C. felis* having a male to female ratio of 1:4. Total RNA was separately extracted from HMT tissues and the HMT-less carcasses that resulted from these dissections as follows. The tissues were frozen at −80° C., ground into a powder with a mortar and pestle, and the powders were equally divided into four 2-ml eppendorf tubes each containing 1 ml of lysis buffer. The lysis buffer contained 4 M guanidinium thiocyanate, 25 mM sodium citrate, pH 7.0, 3% sarcosyl, 0.5M 2-mercaptoethanol, 0.1% antifoam, and 1 mM aurintricarboxylic acid, all available from Sigma Chemical Corporation, St. Louis, Mo. After mixing, the tubes were spun at 14,000 rpm for 2 minutes and the supernatants were transferred to separate 2 ml eppendorf tubes containing 250 µl of phenol, available from Aldrich, Milwaukee, Wis. After mixing, the tubes were spun at 14,000 rpm for 5 minutes and the supernatants were transferred to new 2-ml tubes. This process was repeated 3 times until no proteinaceous matter was visible at the phenol/lysis buffer interface, then 250 µl of chloroform was added to each tube and the contents mixed and spun at 14,000 rpm for 5 minutes followed by transferring the supernatant to a new tube. A volume of isopropanol equal to the volume of the supernatant was added to each tube and the tubes placed on ice for 5 minutes. The tubes were then spun at 14,000 rpm at room temperature for 15 minutes, the supernatants were removed and discarded and the remaining RNA pellets were washed with 70% ethanol and dried. The RNA pellets were resuspended in 100 µl of TE (10 mM Tris, 1 mM ethylenediaminetetraacetic acid (EDTA)). The quantity of RNA in each tube was then determined using a spectrophotometer.

Approximately 10 µg of each RNA was added to separate tubes containing 18.75 µl of loading buffer, which consists of 50% formamide, 16% formaldehyde, 17% water, 7% glycerol, 1×MOPS buffer (a 1:20 dilution of 0.4 M 93-[N-morpholino]propanesulfonic acid (MOPS), 0.1 M sodium acetate, and 20 mM EDTA), 10 µl ethidium bromide, and 10 µl bromophenol blue dye, all available from Sigma. The tubes were heated to 95° C. for 2 minutes then placed on ice. The RNA samples were separated by gel electrophoresis on a 1.5% agarose gel with 3.2% formaldehyde and 1×MOPS buffer; the gel was then soaked in water for 30 minutes prior to transfer to remove excess formaldehyde. The gel was then transferred using standard techniques, described by Sambrook et al., ibid, with 10×SSPE as the transfer buffer onto Nytran® nylon membrane, available from Schleicher and Schuell Inc., Keene, N.H. The membrane was UV cross-linked using the Stratalinker®, available from Stratagene, then prehybridized at 42° C. in 50% formamide, 5×SSPE, 1.2% SDS, 5× Denhardt's reagent, 2.5 mM EDTA, and 100 µg/ml salmon sperm DNA. A probe comprising the allantoinase EST nucleic acid molecule, nCfALN$_{682}$ was labeled with α-$^{32}$P-ATP using a DNA labeling kit, available from Amersham and added to the buffer at a concentration of approximately 1×10$^6$ cpm/ml, and allowed to hybridize for 18 hours at 42° C. The blot was then washed as follows: 10 minutes at 42° C. in 4×SSPE and 1% SDS; 10 minutes at 42° C. in 2×SSPE and 1% SDS; 10 minutes at 42° C. with 0.5×SSPE and 0.5×SDS; and 10 minutes at 42° C. with 0.25×SSPE and 0.25% SDS. The blot was then exposed to film for 1 hour, and the film was developed using standard procedures. Analysis of the developed film revealed that allantoinase mRNA was present in HMT tissues but was not present in non-HMT tissues.

Northern Blot analysis was also conducted to determine whether allantoinase mRNA is expressed only in certain stages of the flea life cycle and whether allantoinase mRNA expression is influenced by feeding. Total RNA was extracted as described above from 1000 fleas at each of the following flea life stages; eggs, first instar larvae, third instar larvae, wandering larvae and pupae and from 1000 adult fleas under the following feeding conditions; unfed, fed on cat blood for 15 minutes, fed on cat blood for 2 hours, fed on cat blood for 8 hours, and fed on cat blood for 24 hours.

Each RNA sample was separated by gel electrophoresis, transferred to nylon membrane and hybridized with α-$^{32}$P-ATP labeled nCfALN$_{682}$ probe as described above. Analysis of the developed film revealed that allantoinase mRNA was expressed in all adult fleas tested regardless of feeding conditions and was expressed by all life stages except for eggs and pupae, the two life stages which do not feed or excrete urine.

EXAMPLE 5

This example describes the cloning, sequencing, recombinant protein expression and purification of a *C. felis* chitin-binding protein nucleic acid molecule. This example also describes the expression of chitin-binding protein mRNA in a variety of flea tissues.

A TA clone from the HMT EST library described in Example 1 was sequenced using standard sequencing methods and shown to have homology to a chitinase-like gene from *Bombyx mori* (silkworm). This clone was digested with EcoRI to excise an insert about 429 nucleotides in length, referred to as chitin-binding protein (CBP) nucleic acid molecule nCfCBP$_{429}$. The insert was isolated by gel purification using a Gel Purification kit, available from Qiagen. Approximately 50 ng of purified nCfCBP$_{429}$ was used to construct a $^{32}$P α-dATP labeled DNA probe using a Megaprime DNA labeling kit, available from Amersham, using the manufacturer's protocols.

The $^{32}$P α-dATP labeled probe was used in a plaque lift hybridization procedure to isolate a clone from the HMT lambda-ZAP unsubtracted cDNA library described in Example 1, using standard hybridization conditions described in Example 4. Plaques that hybridized strongly to the probe were isolated and subjected to in vivo excision. In vivo excision was performed using the Stratagene Ex-Assist™ helper phage system and protocols, to convert a positive plaque to pBluescript™ plasmid DNA, and sequencing was conducted following preparation of DNA with a Qiagen Qiaprep™ spin mini prep kit using the manufacturer's instructions and restriction enzyme digestion with about 1 µl of 20 U/µl each of EcoRI and XhoI, available from New England Biolabs. A clone was isolated from a primary plaque, containing a nucleic acid molecule of about 1128 base pairs, referred to herein as nCfCBP$_{1128}$, having a nucleotide sequence denoted herein as SEQ ID NO:7. The complement of SEQ ID NO:7 is represented herein as SEQ ID NO:9. Sequencing of nCfCBP$_{429}$ indicated that nCfCBP$_{429}$ shares 100% identity with nucleotides 148 through 576 of SEQ ID NO:7.

Translation of SEQ ID NO:7 suggests that nucleic acid molecule nCfCBP$_{1128}$ encodes a full-length chitin-binding protein of 272 amino acids, referred to herein as PCfCfCBP$_{272}$, having an amino acid sequence represented by SEQ ID NO:8, assuming the initiation codon spans from nucleotide 6 through nucleotide 8 of SEQ ID NO:7 and the termination codon spans from nucleotide 822 through nucleotide 824 of SEQ ID NO:7. The coding region encoding PCfCBP$_{272}$, is represented by nucleic acid molecule nCfCBP$_{816}$, having a coding strand with the nucleic acid sequence represented by SEQ ID NO:10 and a complementary strand with nucleic acid sequence represented by SEQ ID NO:12. The amino acid sequence of PCfCBP$_{272}$, also represented as SEQ ID NO:11, predicts that PCfCBP$_{272}$ has an estimated molecular weight of about 30.6 kDa and an estimated pI of about 7.3.

Comparison of amino acid sequence SEQ ID NO:8 with amino acid sequences reported in GenBank indicates that SEQ ID NO:8 showed the most homology, i.e., about 26% identity with a *Lucilia cuprina* peritrophin-44 protein, GenBank Accession No. 407976. Comparison of SEQ ID NO:10 with nucleic acid sequences reported in GenBank indicates that SEQ ID NO:10 showed the most homology, i.e., about 40% with a *Lucilia cuprina* peritrophin-44 nucleic acid molecule, GenBank Accession number L25106. Percent identity calculations were performed using GCG version 9.0 using default parameters.

A nucleic acid molecule comprising nucleotides 59 through 827 of SEQ ID NO:7, encoding a predicted mature flea chitin-binding protein, was PCR amplified from the pBluescript™ clone described above as the template, using sense primer CBP-FE, having nucleotide sequence 5'CGG GAT CCT GCT GAC AGG AAT TCG CCC AC 3', having a BamHI site indicated in bold, designated herein as SEQ ID NO:51, and anti-sense primer CBP-RE, having nucleotide sequence 5'CAT GGT ACC CCT GGT TTA AGC CTT ACT TAG C 3', having a KpnI site indicated in bold, designated herein as SEQ ID NO:52. PCR reactions were performed using standard PCR reaction and thermocycling conditions described in Example 4. The PCR product was digested with BamHI and KpnI and ligated into the vector pTrcHisB, available from Invitrogen, that had been digested with BamHI and KpnI and treated with alkaline phosphatase. The resulting recombinant molecule, referred to herein as pTrc-nCfCBP$_{769}$, was transformed into *E. coli* strain BL21, available from Novagen, to form recombinant cell *E. coli*: pTrc-nCfCBP$_{769}$. The recombinant cell was grown under standard conditions and then incubated in the presence of 0.5 µM IPTG to induce expression of recombinant protein, predicted to be a protein of approximately 32 kDa. Expression of protein was confirmed using Coomassie-blue-stained Tris-glycine gel and by Western blot using a T7 tag antibody which showed expression of an about 32-kDa protein. The protein product was purified by liquid chromatography using a HiTrap™ chelating column charged with NiCl$_2$, available from Pharmacia, and was shown to contain the His tag of the vector when subjected to automated protein sequencing by Edman degradation.

Northern Blot analysis was conducted as described in Example 4 to determine whether CBP mRNA is expressed in only HMT tissue, only in certain stages of the flea life cycle and whether CBP mRNA expression is influenced by feeding. Total RNA was extracted from flea tissues, life stages and feeding conditions as described in Example 4. Each RNA sample was separated by gel electrophoresis, transferred to a nylon membrane and hybridized with α-$^{32}$P-ATP labeled nCfCBP$_{429}$ under the Northern Blotting conditions described in Example 4. Analysis of the developed film revealed that CBP mRNA was expressed in HMT tissues but not in non-HMT tissues. CBP mRNA was also detected in all adult fleas tested regardless of feeding conditions but was not detected in any of the non-adult life stages.

EXAMPLE 6

This example describes the cloning and sequencing of a *C. felis* sodium/potassium ATPase, beta subunit nucleic acid molecule.

A TA clone from the HMT EST library described in Example 1 was sequenced using standard sequencing methods and shown to have homology to the nervous system antigen 1 gene from *Drosophila melanogaster*. This clone was digested with EcoRI to excise an insert about 439 nucleotides in length, referred to as flea NKB nucleic acid molecule nCfNKAB$_{439}$. The insert was isolated by gel purification using a Gel Purification kit, available from Qiagen. Approximately 50 ng of purified nCfNKAB$_{439}$ was used to construct a $^{32}$P α-dATP labeled DNA probe using a Megaprime DNA labeling kit, available from Amersham, using the manufacturer's protocols.

The $^{32}$P α-dATP labeled probe was used in a plaque lift hybridization procedure to isolate a clone from the HMT lambda-ZAP unsubtracted cDNA library described in Example 1, using standard hybridization conditions described in Example 4. Plaques that hybridized strongly to the probe were isolated and subjected to in vivo excision. In vivo excision was performed using the Stratagene Ex-Assist™ helper phage system and protocols, to convert a positive plaque to pBluescript™ plasmid DNA, and sequencing was conducted following preparation of DNA with a Qiagen Qiaprep™ spin mini prep kit using the manufacturer's instructions and restriction enzyme digestion with about 1 µl of 20 U/µl each of EcoRI and XhoI, available from New England Biolabs. A clone was isolated from a secondary plaque, containing a nucleic acid molecule of about 1714 base pairs, referred to herein as nCfNKAB$_{1714}$, having a nucleotide sequence denoted herein as SEQ ID NO:13. The complement of SEQ ID NO:13 is represented herein as SEQ ID NO:15. Sequencing of nCfNKAB$_{439}$ indicates that nC KAB$_{439}$ shared 100% identity with nucleotides 907 through 1345 of SEQ ID NO:13.

Translation of SEQ ID NO:13 suggests that nucleic acid molecule nCfNKAB$_{1714}$ encodes a full-length NKAB protein of 326 amino acids, referred to herein as PCfNKAB$_{326}$, having an amino acid sequence represented by SEQ ID NO:14, assuming the initiation codon spans from nucleotide 294 through nucleotide 296 of SEQ ID NO:13 and the termination codon spans from nucleotide 1272 through nucleotide 1274 of SEQ ID NO:13. The coding region encoding PCfNKAB$_{326}$ is represented by nucleic acid molecule nCfNKAB$_{978}$, having a coding strand with the nucleic acid sequence represented by SEQ ID NO:16 and a complementary strand with nucleic acid sequence represented by SEQ ID NO:18. The amino acid sequence of PCfNKAB$_{326}$, also represented by SEQ ID NO:17 predicts that PCfNKAB$_{326}$ has an estimated molecular weight of about 37.7 kDa and an estimated pI of about 5.

Comparison of amino acid sequence SEQ ID NO:14 with amino acid sequences reported in GenBank indicates that SEQ ID NO:14 showed the most homology, i.e., about 46% identity, with a *Drosophila melanogaster* nervous system antigen 2 protein, GenBank Accession No. 881344. Comparison of SEQ ID NO:16 with nucleic acid sequences reported in GenBank indicates that SEQ ID NO:16 showed the most homology, i.e., about 52% identity, with a *Drosophila melanogaster* nervous system antigen 2 nucleic acid molecule, GenBank Accession number U22440. Percent identity calculations were performed using GCG version 9.0 using default parameters.

EXAMPLE 7

This example describes the cloning and sequencing of a *C. felis* ligand-gated ion channel nucleic acid molecule. This example also describes the expression of ligand-gated ion channel mRNA in a variety of flea tissues.

A TA clone from the HMT EST library described in Example 1 was sequenced using standard sequencing methods and shown to have homology to a human ligand-gated chloride channel nucleic acid molecule. The clone was digested with EcoRI to excise an insert about 376 nucleotides in length, referred to as flea LGIC nucleic acid molecule nCfLGIC$_{376}$. The insert was isolated by gel purification using a Gel Purification kit, available from Qiagen. Approximately 50 ng of purified nCfLGIC$_{376}$ was used to construct a $^{32}$P α-dATP labeled DNA probe using a Megaprime DNA labeling kit available from Amersham, using the manufacturer's protocols.

The $^{32}$P-dATP labeled probe was used in a plaque lift hybridization procedure to isolate a clone from the HMT lambda-ZAP unsubtracted cDNA library described in Example 1, using standard hybridization conditions described in Example 4. Plaques that hybridized strongly to the probe were isolated and subjected to in vivo excision. In vivo excision was performed using the Stratagene Ex-Assist™ helper phage system and protocols, to convert a positive plaque to pBluescript™ plasmid DNA and sequencing was conducted following preparation of DNA with a Qiagen Qiaprep™ spin mini prep kit using the manufacturer's instructions and restriction enzyme digestion with about 1 µl of 20 U/µl each of EcoRI and XhoI, available from New England Biolabs. A clone was isolated from a secondary plaque, containing a nucleic acid molecule of about 2240 base pairs, referred to herein as n nCfLGIC$_{2240}$, having a nucleotide sequence denoted herein as SEQ ID NO:19. The complement of SEQ ID NO:19 is represented herein as SEQ ID NO:21. Sequencing of nCfLGIC$_{376}$ indicates that nCfLGIC$_{376}$ shared 100% identity with nucleotides 763 through 1138 of SEQ ID NO:19.

Translation of SEQ ID NO:19 suggests that nucleic acid molecule nCfLGIC$_{2240}$ encodes a partial-length LGIC protein of 569 amino acids, referred to herein as PCfLGIC$_{569}$, having an amino acid sequence represented by SEQ ID NO:20, assuming the initiation codon spans from nucleotide 1 through nucleotide 3 of SEQ ID NO:19 and the termination codon spans from nucleotide 1708 through nucleotide 1710 of SEQ ID NO:19. The coding region encoding PCfLGIC$_{569}$, is represented by nucleic acid molecule nCfLGIC$_{1707}$, having a coding strand with the nucleic acid sequence represented by SEQ ID NO:22 and a complementary strand with nucleic acid sequence represented by SEQ ID NO:24. The amino acid sequence of PCfLGIC$_{569}$ also represented as SEQ ID NO:23, predicts that PCfLGIC$_{569}$ has an estimated molecular weight of about 64 kDa and an estimated pI of about 6.6.

Comparison of amino acid sequence SEQ ID NO:20 with amino acid sequences reported in GenBank indicates that SEQ ID NO:20 showed the most homology, i.e., about 23% identity, with a *Rattus norvegicus* glycine receptor alpha-3 chain precursor protein, GenBank Accession No. 121580. Comparison of SEQ ID NO:22 with nucleic acid sequences reported in GenBank indicates that SEQ ID NO:22 showed the most homology, i.e., about 38% identity, with a human glycine receptor alpha-3 subunit nucleic acid molecule, GenBank Accession number AF017715. Percent identity calculations were performed using GCG version 9.0 using default parameters.

Northern Blot analysis was conducted as described in Example 4 to determine whether LGIC mRNA is expressed in only HMT tissue. Total RNA was extracted from HMT tissues and non-HMT tissues as described in Example 4. Each RNA sample was separated by gel electrophoresis, transferred to nylon membranes and hybridized with α-$^{32}$P-ATP labeled nCfLGIC$_{376}$ under the Northern Blotting conditions described in Example 4. Analysis of the developed film revealed that LGIC mRNA was expressed in HMT tissues but not in non-HMT tissues.

Additional nucleic acid sequence corresponding to the coding regions at the 5' end of the LGIC cDNA described above was isolated by PCR using the RACE cDNA pool prepared as described in Example 3 as the template. A first PCR reaction was conducted using reverse primer LGIC-R4, which is complementary to nucleotides 200-223 of SEQ ID NO:19, having a nucleic acid sequence 5' GCG ATA CTG GTG GTA CTG GTG AAG 3', denoted herein as SEQ ID NO:1932 was used with the forward linker primer Adapter Primer 1, having a nucleic acid sequence 5' CCA TCC TAA TAC GAC TCA CTA TAG GGC 3', denoted herein as SEQ ID NO:1933 using standard PCR reaction conditions and the following thermocycling conditions: (1) 94° C. for 30 seconds, (2) 5 cycles of 94° C. for 10 seconds then 72° C. for 4 minutes, (3) 5 cycles of 94° C. for 10 seconds then 70° C. for 4 minutes, and (4) 25 cycles of 94° C. for 10 seconds then 68° C. for 4 minutes. The reaction product was separated on a 1.5% agarose gel and stained by ethidium bromide, but no clear bands were seen. The first PCR reaction product was diluted 1:50 in water and used as template for a second PCR reaction using reverse primer LGIC-R5, which is complementary to nucleotides 88-110 of SEQ ID NO:19, having a nucleic acid sequence 5' GAG GTG GTT GTC TTC AGT GGT TG 3', denoted herein as SEQ ID NO:1934 and forward Adapter Primer 2, having a nucleic acid sequence 5' ACT CAC TAT AGG GCT CGA GCG GC 3', denoted herein as SEQ ID NO:1935 under the same reaction conditions described for the first PCR reaction. The reaction product was separated by electrophoresis on a 1.5% agarose gel and stained with ethidium bromide revealing an approximately 700 bp band. This band was cut from the gel and purified using the QIAquick Gel Extraction Kit, then ligated into the pCR II TA Cloning vector, available from Invitrogen Corporation, Carlsbad, Calif., using the manufacture's protocol. This clone, referred to herein as nCfLGIC$_{613}$ and having a coding sequence denoted SEQ ID NO:1859, and a complementary strand denoted herein as SEQ ID NO:1860 was sequenced using an ABI PRISM 377 automatic DNA Sequencer, available from Perkin Elmer, Branchburg, N.J. Sequence analysis revealed that nucleotides 503-613 of nCfLGIC$_{613}$ had 100% identity with nucleotides 1-110 of SEQ ID NO:19. The two sequences were aligned to form a 2739 nucleotide contiguous sequence, referred to herein as nCfLGIC$_{2739}$, having a coding strand denoted herein as SEQ ID NO:1861 and a complementary strand denoted herein as SEQ ID NO:1863. Translation of SEQ ID NO:1861 suggests that nucleic acid molecule nCfLGIC$_{2739}$ encodes a full-length LGIC protein of 672 amino acids, referred to herein as PCfLGIC$_{672}$, having an amino acid sequence represented by SEQ ID NO:1862, assuming the initiation codon spans from nucleotide 191 through nucleotide 193 of SEQ ID NO:1861 and the termination codon spans from nucleotide 2207 through nucleotide 2209 of SEQ ID NO:1861. The coding region encoding PCfLGIC$_{672}$, is represented by nucleic acid molecule nCfLGIC$_{2016}$, having a coding strand with the nucleic acid sequence represented by SEQ ID NO:1864 and a complementary strand with nucleic acid sequence represented by SEQ ID NO:1866. The amino acid sequence of PCfLGIC$_{672}$, i.e. SEQ ID NO:1862, predicts that PCfLGIC$_{672}$ has an estimated molecular weight of about 75.5 kDa and an estimated pI of about 5.89.

Comparison of amino acid sequence SEQ ID NO:1862 with amino acid sequences reported in GenBank indicates that SEQ ID NO:1862 showed the most homology, i.e., 31.4% identity with glycine receptor Alpha 3 chain precursor cDNA from *Rattus norvegicus* (Accession # P24524). Comparison of SEQ ID NO:1864 with nucleic acid sequences reported in GenBank indicates that SEQ ID NO:1864 showed the most homology, i.e., about 43.1% identity with the *Homo sapiens* glycine receptor, alpha3 cDNA (Accession # NP006520). Percent identity calculations were performed using GCG version 9.0 using default parameters.

A LGIC nucleic acid molecule for recombinant expression of the predicted extracellular domain was produced as follows. In order to ligate the region encoding the predicted extracellular domain of the LGIC cDNA into the InsectSelect™ expression vector pIB/V5-His, two separate but overlapping DNA fragments were generated to be used as the template in the PCR overlap extension. To generate a 3' DNA fragment, a first PCR reaction was conducted using forward primer LGIC-ECD-D2F, which corresponds to nucleotides 2-25 of SEQ ID NO:19, having a nucleic acid sequence 5' CAA TTT TAA ACG CAT CCA CGA CCG 3', denoted herein as SEQ ID NO:1936, and reverse primer LGIC-ECD-RE, which is complementary to nucleotides 937-961 of SEQ ID NO:19, having a nucleic acid sequence 5' CCG CTC GAG CGA CCC ATT TCA CGA CTT ATT TGA ATC G 3', denoted herein as SEQ ID NO:1937 and having a XhoI site indicated in bold, to amplify nucleotides 2-963 from SEQ ID NO:19 which was used as template under standard PCR reaction conditions and the following thermocycling conditions: (1) 94° C. for 30 seconds, (2) 25 cycles of 94° C. for 10 seconds, 55° C. for 10 seconds, and 72° C. for 3 minutes. The products of this reaction were separated on a 1.5% agarose gel, and a band corresponding to an approximately 960 nucleotide molecule was cut from the gel and purified using the QIAquick Gel Extraction Kit as described above. To generate a 5' cDNA fragment, a second PCR reaction was conducted using reverse primer LGIC-R5 (SEQ ID NO:1934) and forward primer LGIC-ECD-FE, which corresponds to nucleotides 188-215 of SEQ ID NO:1859, having a nucleic acid sequence 5' GGA ATT CTA AAA TGC ACA ACA AAA TCC TGG TCC TGG 3', denoted herein as SEQ ID NO:1938, and having an EcoRI site indicated in bold, using SEQ ID NO:1859 as the template under the thermocycling conditions described for generating the 3' fragment. The products of this reaction were separated on a 1.5% agarose gel, and a band corresponding to an approximately 425 nucleotide molecule was cut from the gel and purified using the QIAquick Gel Extraction Kit as described above.

For the PCR overlap extension reaction, the 5' and 3' cDNA fragments described above were used as the template in a PCR reaction with forward primer LGIC-ECD-FE and reverse primer LGIC-ECD-RE under the thermocycling conditions described for generating the 5' and 3' fragments. The products of this reaction were separated on a 1.5% agarose gel, and a band corresponding to an approximately 1300 nucleotide molecule, as visualized by agarose gel electrophoresis and ethidium bromide staining, referred to herein as nCfLGIC$_{1300}$, was cut from the gel and purified using the QIAquick Gel Extraction Kit as described above.

The product of the PCR overlap extension reaction was then digested with EcoRI and XhoI restriction endonucleases, available from New England BioLabs, Inc., Beverly, Mass., for 18 hours at 37°. The digestion product was purified using the QIAquick Nucleotide Removal Kit, available from Qiagen, and ligated into the vector pIB/V5-His which had also been digested with EcoRI and XhoI and treated with shrimp alkaline phosphatase, available from New England BioLabs, Inc. for 30 minutes at 37°. Following standard transformation procedures, a bacterial clone containing the plasmid pIB/V5-His-nCfLGIC$_{1300}$ was isolated. DNA sequence analysis of pIB/V5-His-nCfLGIC$_{1300}$ confirmed that nucleotides 188-1464 of SEQ ID NO:1861 had been successfully ligated into the pIB/V5-His expression vector in frame with the C-terminal V5 epitope encoded by the vector.

EXAMPLE 8

This example describes the cloning and sequencing of a *C. felis* ANON/23DA nucleic acid molecule. This example also describes the expression of ANON/23DA mRNA in a variety of flea tissues.

A TA clone from the HMT EST library described in Example 1 was sequenced using standard sequencing methods and shown to have homology to an ANON/23DA gene from *Drosophila melanogaster*. This clone was digested with EcoRI to excise an insert about 177 nucleotides in length, referred to as flea ANON nucleic acid molecule nCfANON$_{177}$. The insert was isolated by gel purification using a Gel Purification kit, available from Qiagen. Approximately 50 ng of purified nCfANON$_{177}$ was used to construct a $^{32}$P α-dATP labeled DNA probe using a Megaprime DNA labeling kit, available from Amersham, using the manufacturer's protocols.

The $^{32}$P-dATP labeled probe was used in a plaque lift hybridization procedure to isolate a clone from the HMT lambda-ZAP unsubtracted cDNA library described in Example 1, using standard hybridization conditions described in Example 4. Plaques that hybridized strongly to the probe were isolated and subjected to in vivo excision. In vivo excision was performed using the Stratagene Ex-Assist™ helper phage system and protocols, to convert a positive plaque to pBluescript™ plasmid DNA and sequencing of DNA was conducted following preparation with a Qiagen Qiaprep™ spin mini prep kit using the manufacturer's instructions and restriction enzyme digestion with about 1 μl of 20 U/μl each of EcoRI and XhoI, available from New England Biolabs. A clone was isolated from a secondary plaque, containing a nucleic acid molecule of about 1429 base pairs, referred to herein as nCfANON$_{1429}$, having a nucleotide sequence denoted herein as SEQ ID NO:25. The complement of SEQ ID NO:25 is represented herein as SEQ ID NO:27. Sequencing of nCfANON$_{177}$ indicates that nCfANON$_{177}$ shared 100% identity with nucleotides 279 through 455 of SEQ ID NO:25.

Translation of SEQ ID NO:25 suggests that nucleic acid molecule nCfANON$_{1429}$ encodes a full-length ANON protein of 398 amino acids, referred to herein as PCfANON$_{398}$, having an amino acid sequence represented by SEQ ID NO:26, assuming the initiation codon spans from nucleotide 18 through nucleotide 20 of SEQ ID NO:25 and the termination codon spans from nucleotide 1212 through nucleotide 1214 of SEQ ID NO:25. The coding region encoding PCfANON$_{398}$, is represented by nucleic acid molecule nCfANON$_{1194}$, having a coding strand with the nucleic acid sequence represented by SEQ ID NO:28 and a complementary strand with nucleic acid sequence represented by SEQ ID NO:30. The amino acid sequence of PCfANON$_{398}$, also represented as SEQ ID NO:29, predicts that PCfANON$_{398}$ has an estimated molecular weight of about 45 kDa and an estimated pI of about 8.8.

Comparison of amino acid sequence SEQ ID NO:26 with amino acid sequences reported in GenBank indicates that SEQ ID NO:26 showed the most homology, i.e., about 65% identity, with a *Drosophila melanogaster* ANON/23DA protein, GenBank Accession No. 924937. Comparison of SEQ ID NO:28 with nucleic acid sequences reported in GenBank indicates that SEQ ID NO:28 showed the most homology, i.e., about 60% identity, with a *Drosophila melanogaster* ANON/23DA nucleic acid molecule, GenBank Accession number U29170. Percent identity calculations were performed using GCG version 9.0 using default parameters.

Northern Blot analysis was conducted as described in Example 4 to determine whether ANON mRNA is expressed in only HMT tissue, only in certain stages of the flea life cycle and whether ANON mRNA expression is influenced by feeding. Total RNA was extracted from flea tissues, life stages and feeding conditions as described in Example 4. Each RNA sample was separated by gel electrophoresis, transferred to nylon membranes and hybridized with $\alpha$-$^{32}$P-ATP labeled nCfANON$_{177}$ under the Northern Blotting conditions described in Example 4. Analysis of the developed film revealed that ANON mRNA was expressed in non-HMT tissues but not in HMT tissues. ANON mRNA was also detected in all adult fleas tested regardless of feeding conditions and in the wandering larvae and pupal life stages.

EXAMPLE 9

This example describes the cloning and sequencing of a *C. felis* malvolio nucleic acid molecule.

A TA clone from the HMT EST library described in Example 1 was digested with EcoRI to excise an insert about 432 nucleotides in length, referred to as nCfMALV$_{432}$. The insert was isolated by gel purification using a Gel Purification kit, available from Qiagen and sequenced using standard sequencing methods and shown to have homology to a malvolio gene from *Drosophila melanogaster*, hereinafter referred to as a flea MALV nucleic acid molecule.

Sequence information from nCfMALV$_{432}$ was used to design PCR primers to amplify a *C. felis* MALV nucleic acid molecule from the HMT unsubtracted library described in Example 1 using a nested PCR as follows. Sense primer MALV R1, having the nucleotide sequence 5' CCA TTA TTA ACC TGG TCG ACC AC 3', designated SEQ ID NO:41 and corresponding to nucleotides 365-387 of nCfMALV$_{432}$ and reverse primer M13 Reverse, having the nucleotide sequence 5' GGA AAC AGT ATG ACC ATG 3', designated SEQ ID NO:42 were used in a first PCR reaction using HMT unsubtracted library as the template using standard PCR reaction and thermocycling conditions, with the exception that 2 µl of template was used. The reaction product from the first PCR reaction was diluted 1:50 and used as the template in a second PCR reaction as follows. Reverse primer malvolio R2, having a nucleotide sequence 5' CGC TAT AGT CGG TAG GGT CGC 3', designated SEQ ID NO:43 and corresponding to nucleotides 239-259 of nCfMALV$_{432}$ and forward primer T3, having a nucleotide sequence 5' AAT TAA CCC TCA CTA AAG GG 3' were used in a second PCR reaction under standard PCR reaction and thermocycling conditions.

The second PCR reaction resulted in an approximately 1000 bp PCR product which was separated by electrophoresis on a 1.5% agarose gel, excised and purified using a Gel Purification Kit, available from Qiagen. The purified PCR product was ligated into the pCRII™, Original TA cloning vector, available from Invitrogen. The ligation reaction was then used to transform INV αF' One Shot™ competent cells, available from Invitrogen, which were plated on LB agar with 50 micrograms per milliliter (µg/ml) ampicillin, available from Sigma-Aldrich Co., and 50 µg/ml X-Gal, available from Fisher Biotech. A clone was isolated from the ligation mix containing a nucleic acid molecule of about 765 base pairs, referred to herein as nCfMALV$_{765}$, having a nucleotide sequence denoted herein as SEQ ID NO:31. The complement of SEQ ID NO:31 is represented herein as SEQ ID NO:33.

Translation of SEQ ID NO:31 suggests that nucleic acid molecule nCfMALV$_{765}$ encodes a partial-length MALV protein of 254 amino acids, referred to herein as PCfMALV$_{254}$, having an amino acid sequence represented by SEQ ID NO:32, assuming the initiation codon spans from nucleotide 2 through nucleotide 4 of SEQ ID NO:31 and the last codon spans from nucleotide 761 through nucleotide 763 of SEQ ID NO:31. The coding region encoding PCfMALV$_{254}$, is represented by nucleic acid molecule nCfMALV$_{762}$, having a coding strand with the nucleic acid sequence represented by SEQ ID NO:34 and a complementary strand with nucleic acid sequence represented by SEQ ID NO:36. The amino acid sequence of PCfMALV$_{254}$, also represented as SEQ ID NO:35, predicts that PCfMALV$_{254}$ has an estimated molecular weight of about 36 kDa and an estimated pI of about 4.9.

Comparison of amino acid sequence SEQ ID NO:32 with amino acid sequences reported in GenBank indicates that SEQ ID NO:32 showed the most homology, i.e., about 71% identity, with a *Drosophila melanogaster* malvolio protein, GenBank Accession No. 780776. Comparison of SEQ ID NO:34 with nucleic acid sequences reported in GenBank indicates that SEQ ID NO:34 showed the most homology, i.e., about 63% identity, with a *Drosophila melanogaster* malvolio nucleic acid molecule, GenBank Accession number U23948. Percent identity calculations were performed using GCG version 9.0 using default parameters.

EXAMPLE 10

This example describes the cloning, sequencing, and recombinant expression of a *C. felis* odorant-binding protein-like (OS-D) nucleic acid molecule. This example also describes the expression of OS-D mRNA in a variety of flea tissues.

A *C. felis* OS-D nucleic acid molecule of about 311 nucleotides was isolated from a cat blood-fed adult flea cDNA library, prepared as described in example 8 of PCT publication WO 96/11706 by Grieve et al., published Apr. 25, 1996, by PCR amplification as follows. Sense primer 5'newBsaI5', having a nucleotide sequence 5' CAA AAC TGG TCT CCC CGC TC 3', denoted SEQ ID NO:57 was used in combination with vector primer T7, having a nucleic acid sequence 5' TAA TAC GAC TCA CTA TAG GG 3', denoted SEQ ID NO:58, in a first PCR reaction using the cat blood-fed adult flea cDNA library as the template under standard PCR reaction and thermocycling conditions. A 311-nucleotide fragment, denoted nCfOSD$_{311}$ was isolated and shown to encode a partial length protein of 45 amino acids having a sequence similar to *Drosophila melanogaster* OS-D protein. Since primer 5'newBsaI5' was designed to be specific for the *C. felis* serpin constant region, nCfOSD$_{311}$ is believed to have been fortuitously amplified in this PCR reaction.

To isolate a flea OS-D nucleic acid molecule encoding a full-length OS-D protein, nucleic acid molecule nCfOSD$_{311}$ was used to design primers for a nested PCR as follows. Sense primer OSD-R1, having a nucleotide sequence 5'

GGT TCG CCT CTC TTC ACT TG 3', which is complementary in sequence to nucleotides 108-127 of nCfOSD$_{311}$, denoted SEQ ID NO:59, was used in combination with M13 reverse primer, SEQ ID NO:54, in a first PCR reaction using the cat blood-fed adult C. felis cDNA library as the template. The product of the first reaction was diluted 1:50 and used as the template for a second PCR reaction using reverse primer OSD-R2, having a nucleotide sequence 5' CGG TTG GAT CGT AAA CTG CAG 3', which is complementary in sequence to nucleotides 52-72 of nCfOSD$_{31}$, denoted SEQ ID NO:60, and forward primer T3, SEQ ID NO:56. Each PCR reaction was conducted under standard PCR reaction and thermocycling conditions with the exception that an annealing temperature of 55° C. was used rather than 50° C.

A DNA fragment of about 365 nucleotides, referred to herein as nCfOSD$_{365}$, was isolated from the second PCR product and purified using a Gel Purification Kit, available from Qiagen. The purified fragment was ligated into the pCRII™ TA cloning vector, available from Invitrogen, and sequenced using standard sequencing methods. Sequencing revealed that nucleotides 294-365 of nCfOSD$_{365}$ match nucleotides 1-72 of molecule nCfOSD$_{311}$ described above. The sequences from the partial length clones described were aligned to produce a sequence including a full-length coding region of 604 nucleotides, referred to as nCfOSD$_{604}$, denoted herein as SEQ ID NO:37, where nCfOSD$_{311}$, is identical in sequence to nucleotides 294-604 of SEQ ID NO:37 and nCfOSD$_{365}$ is identical in sequence to nucleotides 1-365 of SEQ ID NO:37. The complement of SEQ ID NO:37 is represented herein as SEQ ID NO:39.

Translation of SEQ ID NO:37 suggests that nucleic acid molecule nCfOSD$_{604}$ encodes a full-length OS-D protein of 135 amino acids, referred to herein as PCfOSD$_{135}$, having an amino acid sequence represented by SEQ ID NO:38, assuming the initiation codon spans from nucleotide 26 through nucleotide 28 of SEQ ID NO:37 and the termination codon spans from nucleotide 431 through nucleotide 433 of SEQ ID NO:37. The coding region encoding PCfOSD$_{135}$, is represented by nucleic acid molecule nCfOSD$_{405}$, having a coding strand with the nucleic acid sequence represented by SEQ ID NO:40 and a complementary strand with nucleic acid sequence represented by SEQ ID NO:42. The amino acid sequence of PCfOSD$_{135}$, also represented as SEQ ID NO:41, predicts that PCfOSD$_{135}$ has an estimated molecular weight of about 15 kDa and an estimated pI of about 8.6. Analysis of SEQ ID NO:38 suggests the presence of a signal peptide encoded by a stretch of amino acids spanning from about amino acid 1 through about amino acid 20. The proposed mature protein, denoted herein as PCfOSD$_{115}$, contains about 115 amino acids corresponding to amino acids 21 through 135 of SEQ ID NO:38. The predicted pI of the mature protein (i.e. the protein with the signal peptide removed) is 6.6.

Comparison of amino acid sequence SEQ ID NO:38 with amino acid sequences reported in GenBank indicates that SEQ ID NO:38 showed the most homology, i.e., about 60% identity, with a Schistocerca gregaria chemosensory protein CSP-sg4, GenBank Accession No. 3283938. Comparison of SEQ ID NO:40 with nucleic acid sequences reported in GenBank indicates that SEQ ID NO:40 showed the most homology, i.e., about 58% identity, with a Schistocerca gregaria chemosensory protein CSP-sg4 nucleic acid molecule, GenBank Accession number AF070964. Comparison of SEQ ID NO:40 with nucleic acid molecules sequenced when screening the HNC subtracted and unsubtracted libraries described in Example 2 revealed that OS-D (i.e. SEQ ID NO:40) is expressed in each of these libraries. Additional sequence analysis revealed that there are four cysteines present in C. felis OS-D which are conserved in sequence alignments with the four cysteines of OS-D-like molecules of other insects, including D. melanogaser OS-D protein GenBank Accession No. U02546, S. gregaria chemosensory protein CSP-sg4, GenBank Accession number AF070964, and cockroach leg regenerative protein, GenBank Accession No. AF030340. Percent identity calculations and additional sequence analysis was performed using GCG version 9.0 using default parameters.

A nucleic acid molecule comprising nucleotides 91 through 447 of SEQ ID NO:37, encoding a predicted mature flea OS-D protein, was PCR amplified using the pBluescript™ clone described above as the template, using sense primer OSD-FE, having nucleotide sequence 5' CGC GGA TCC AGA AGA TAA ATA TAC TAG CAA ATT TGA TAA C$_3$', having a BamHI site indicated in bold, designated herein as SEQ ID NO:61, and anti-sense primer OSD-RE, having nucleotide sequence 5' GAG GAA TTC CTC TTT TTG GAA ATT TAA ACT GTA ACG G 3', having an EcoRI site indicated in bold, designated herein as SEQ ID NO:62. PCR reactions were performed using standard PCR reaction and thermocycling conditions described in Example 4; the product was separated by agarose gel electrophoresis, and a fragment was excised and purified using a Gel Purification Kit, available from Qiagen. The fragment was digested with BamHI and EcoRI and ligated into the vector pTrcHisB, available from Invitrogen, that had been digested with BamHI and EcoRI and treated with alkaline phosphatase. The resulting recombinant molecule, referred to herein as pTrc-nCfOSD$_{357}$, was transformed into E. coli strain BL21, available from Novagen, to form recombinant cell E. coli: pTrc-nCfOSD$_{357}$.

The recombinant cell was grown under standard conditions then incubated in the presence of 0.5 mM IPTG to induce expression of recombinant protein, predicted to be approximately 17-kDa. Expression of protein was confirmed using Coomassie-blue-stained Tris-glycine gel and by Western blot using a T7 tag antibody which showed expression of an about 17 kDa protein.

A Northern Blot analysis was conducted as follows to determine whether OS-D mRNA is expressed exclusively in HNC tissues. HNC tissues were dissected from 1500 adult cat blood-fed C. felis having a male to female ratio of 1:4. Total RNA was separately extracted from HNC tissues and the HNC-less carcasses that resulted from these dissections using a standard guanidine lysis method, described by Sambrook et al., ibid.

Approximately 15 µg of each RNA were separated by electrophoresis on either Glyoxal gels with RNA prepared according to Burnett, Biotechniques, 22:4, pp. 668-671, 1997, or formaldehyde gels with RNA prepared according to Sambrook et al., ibid. Following electrophoresis, RNA was blotted to Hybond N nylon membranes, available from Amersham, according to the protocols described in Burnett and Sambrook et el. ibid. The membrane was UV cross-linked using the Stratalinker®, available from Stratagene, and placed in approximately 30 ml of hybridization buffer consisting of 5×SSPE, 1% Sarcosyl, 50% formamide, 5× Denhardt's reagent and 25 mM EDTA at 42° C. for approximately 3 to 6 hours. A probe comprising the flea OS-D nucleic acid molecule nCfOSD$_{357}$ was labeled with α-$^{32}$P-ATP using a DNA labeling kit, available from Amersham and added to the buffer at a concentration of approximately 1×10$^6$ cpm/ml, and allowed to hybridize for about 14 to 18 hours at 42° C. The blot was then washed twice for 10 minutes per wash in 0.5×SSPE and 0.1% sarcosyl at 55° C.

and exposed to film for autoradiography. Analysis of the developed film showed that there was greater expression of OS-D mRNA in HNC tissues compared to non-HNC tissues, indicating possible upregulation of OS-D in flea head and nerve cords.

EXAMPLE 11

This example describes the cloning and sequencing of a *C. felis* N-methyl-D-aspartate receptor associated (NMDA) nucleic acid molecule.

A TA clone from the HMT EST library described in Example 1 was sequenced using standard sequencing methods and shown to have significant homology to NMDA genes. This clone was digested with EcoRI to excise an insert 279 nucleotides in length, referred to as flea NMDA nucleic acid molecule nCfNMDA$_{279}$. The insert was isolated by gel purification using a Gel Purification kit, available from Qiagen. Approximately 50 ng of purified nCfNMDA$_{279}$ was used to construct a $^{32}$P α-dATP labeled DNA probe using a Megaprime DNA labeling kit, available from Amersham, using the manufacturer's protocols.

The $^{32}$P α-dATP labeled probe was used in a plaque lift hybridization procedure to isolate a clone from the HMT lambda-ZAP unsubtracted cDNA library described in Example 1, using standard hybridization conditions described in Example 4. Plaques that hybridized strongly to the probe were isolated and subjected to in vivo excision. In vivo excision was performed using the Stratagene Ex-Assist™ helper phage system and protocols, to convert a positive plaque to pBluescript™ plasmid DNA and sequencing was conducted following preparation of DNA with a Qiagen Qiaprep™ spin mini prep kit using the manufacturer's instructions and restriction enzyme digestion with about 1 μl of 20 U/μl each of EcoRI and XhoI, available from New England Biolabs. A clone was isolated from a secondary plaque, containing a nucleic acid molecule of about 1227 base pairs, referred to herein as nCfNMDA$_{1227}$, having a nucleotide sequence denoted herein as SEQ ID NO:43. The complement of SEQ ID NO:43 is represented herein as SEQ ID NO:45. Sequencing of nCfNMDA$_{279}$ indicates that nCfNMDA$_{279}$ shared 100% identity with nucleotides 709 through 987 of SEQ ID NO:43.

Translation of SEQ ID NO:43 suggests that nucleic acid molecule nCfNMDA$_{1227}$ encodes a full-length NMDA protein of 246 amino acids, referred to herein as PCfNMDA$_{246}$, having an amino acid sequence represented by SEQ ID NO:44, assuming the initiation codon spans from nucleotide 312 through nucleotide 314 of SEQ ID NO:43 and the termination codon spans from nucleotide 1050 through nucleotide 1052 of SEQ ID NO:43. The coding region encoding PCfNMDA$_{246}$, is represented by nucleic acid molecule nCfNMDA$_{738}$, having a coding strand with the nucleic acid sequence represented by SEQ ID NO:46 and a complementary strand with nucleic acid sequence represented by SEQ ID NO:48. The amino acid sequence of PCfNMDA$_{246}$, also represented as SEQ ID NO:47 predicts that PCfNMDA$_{246}$ has an estimated molecular weight of about 27 kDa and an estimated pI of about 5.6.

Comparison of amino acid sequence SEQ ID NO:44 with amino acid sequences reported in GenBank indicates that SEQ ID NO:44 showed the most homology, i.e., about 34% identity, with a *Emericella nidulans* negative-acting regulatory protein, GenBank Accession No.3676056. Comparison of SEQ ID NO:46 with nucleic acid sequences reported in GenBank indicates that SEQ ID NO:46 showed the most homology, i.e., about 45% identity, with a *Drosophila melanogaster* NMDA nucleic acid molecule, GenBank Accession number L37377. Percent identity calculations were performed using GCG version 9.0 using default parameters.

EXAMPLE 12

This example describes the cloning and sequencing of *C. felis* chemical sense related lipophilic ligand binding protein nucleic acid molecule. This example also describes the expression of chemical sense related lipophilic ligand binding protein mRNA in a variety of flea tissues.

A TA clone from the HNC EST library described in Example 2 was sequenced using standard sequencing methods and shown to have significant homology to chemical sense related lipophilic ligand binding protein (CLBP) genes. This clone was digested with EcoRI to excise an insert 339 nucleotides in length, referred to as flea CLBP nucleic acid molecule nCfCLBP$_{339}$. The insert was isolated by gel purification using a Gel Purification kit, available from Qiagen, Chatsworth, Calif. Approximately 50 ng of purified nCfCLBP$_{339}$ was used to construct a $^{32}$P α-dATP labeled DNA probe using a Megaprime DNA labeling kit, available from Amersham, using the manufacturer's protocols.

The $^{32}$P α-dATP labeled probe was used in a standard plaque lift hybridization procedure to isolate a clone from the HNC lambda-ZAP unsubtracted cDNA library described in Example 2. The following hybridization conditions were used. Filters were hybridized with about 5×10$^7$ counts per minute (cpm) per ml of the probe in 100 ml of buffer (5×SSPE, 1% Sarcosyl, 0.1 mg/ml BLOTTO) at 45° C. for about 14 hours. The filters were washed twice for 20 minutes per wash in 500 ml of 0.5×SSPE and 0.1% Sarcosyl at 55° C. and subjected to autoradiography. Two plaques that hybridized strongly to the probe were isolated and subjected to in vivo excision using the Stratagene Ex-Assist™ helper phage system and protocols. Miniprep DNA was prepared from each positive clone using a Quantum Prep mini prep kit, available from BioRad, Hercules, Calif., and sequenced using standard sequencing procedures. Sequencing revealed that the two positive clones share 97% amino acid identity to each other. The first clone contained a nucleic acid molecule of about 633 nucleotides, referred to herein as nCfCLBP1A$_{633}$, having a nucleotide sequence denoted herein as SEQ ID NO:153. The complement of SEQ ID NO:153 is represented herein as SEQ ID NO:155. The second clone contained a nucleic acid molecule of about 631 nucleotides, referred to herein as nCfCLBP2A$_{631}$, having a nucleotide sequence denoted herein as SEQ ID NO:162. The complement of SEQ ID NO:162 is represented herein as SEQ ID NO:164. Sequencing of nCfCLBP$_{340}$ indicated that nCfCLBP$_{339}$ shared 100% identity with nucleotides 1 through 339 of SEQ ID NO:153 and shared 100% identity with nucleotides 2 through 339 of SEQ ID NO:162.

Translation of SEQ ID NO:153 suggests that nucleic acid molecule nCfCLBP1A$_{633}$ encodes a full-length CLBP protein of 147 amino acids, referred to herein as PCfCLBP1A$_{147}$, having an amino acid sequence represented by SEQ ID NO:154, assuming the initiation codon spans from nucleotide 67 through nucleotide 69 of SEQ ID NO:153 and the termination codon spans from nucleotide 511 through nucleotide 513 of SEQ ID NO:153. The coding region encoding PCfCLBP1A$_{47}$, is represented by nucleic acid molecule nCfCLBP1A$_{441}$, having a coding strand with the nucleic acid sequence represented by SEQ ID NO:156 and a complementary strand with nucleic acid sequence represented by SEQ ID NO:158. The amino acid sequence of PCfCLBP1A$_{147}$, also represented by SEQ ID NO:157, predicts that PCfCLBP1A$_{147}$ has an estimated molecular weight of about 15 kDa and an estimated pI of about 5.

Analysis of SEQ ID NO:154 suggests the presence of a signal peptide encoded by a stretch of amino acids spanning from about amino acid 1 through about amino acid 19. The proposed mature protein, denoted herein as PCfCLBP1A$_{128}$, contains 128 amino acids which is represented herein as SEQ ID NO:160. PCfCLBP1A$_{128}$ is encoded by a nucleic acid molecule denoted nCfCLBP1A$_3$84 having a coding strand with nucleic acid sequence SEQ ID NO:159 and a complementary strand with SEQ ID NO:161.

Translation of SEQ ID NO:162 suggests that nucleic acid molecule nCfCLBP2A$_{63}$, encodes a full-length CLBP protein of 147 amino acids, referred to herein as PCfCLBP2A$_{147}$, having an amino acid sequence represented by SEQ ID NO:163, assuming the initiation codon spans from nucleotide 65 through nucleotide 67 of SEQ ID NO:162 and the termination codon spans from nucleotide 509 through nucleotide 511 of SEQ ID NO:162. The coding region encoding PCfCLBP2A$_{147}$, is represented by nucleic acid molecule nCfCLBP2A$_{441}$, having a coding strand with the nucleic acid sequence represented by SEQ ID NO:165 and a complementary strand with nucleic acid sequence represented by SEQ ID NO:167. The amino acid sequence of PCfCLBP2A$_{147}$ predicts that PCfCLBP2A$_{147}$ has an estimated molecular weight of about 15 kDa and an estimated pI of about 5.

Analysis of SEQ ID NO:163 suggests the presence of a signal peptide encoded by a stretch of amino acids spanning from about amino acid 1 through about amino acid 19. The proposed mature protein, denoted herein as PCfCLBP2A$_{128}$, contains about 128 amino acids which is represented herein as SEQ ID NO:169. PCfCLBP2A$_{128}$ is encoded by a nucleic acid molecule denoted nCfCLBP2A$_{314}$ having a coding strand with nucleic acid sequence SEQ ID NO:168 and a complementary strand with SEQ ID NO:170.

Comparison of amino acid sequences SEQ ID NO:154 and SEQ ID NO:163 with amino acid sequences reported in GenBank indicates that each sequence showed the most homology, i.e., about 29% identity, with a *Drosophila melanogaster* pheromone binding protein related protein 2 (PB-PRP-2), GenBank Accession No. 1709595. Percent identity calculations were performed using GCG version 9.0 using default parameters. Blast comparison of nucleic acid sequences SEQ ID NO:156 and SEQ ID NO:165 with nucleic acid sequences reported in GenBank indicates that each sequence showed the most homology to a human Xp22 PAC PRCI1-5G11 nucleic acid molecule, GenBank Accession number AC002369. Pairwise identity could not be performed as the human clone in GenBank is too large to load into GCG version 9.0. Blast comparison performed using default parameters showed an insignificant level of identity of 0.87. Additional sequence analysis revealed that there are six cysteines present in *C. felis* CLBP which are conserved in sequence alignments with the six cysteines of neuronal/sense-related molecules in the PBP/GOBP family, including *D. melanogaser* PBPRP-2, GenBank Accession No. 1709595, and PBPRP-5, GenBank Accession No. P54195, proteins, and *Phormia regina* chemical sense related lipophilic ligand binding protein (CSRLLBP), GenBank Accession No. S65458.

A Northern Blot analysis was conducted to determine whether CLBP mRNA is expressed exclusively in HNC tissues. HNC tissues were dissected, total RNA was isolated and separated by electrophoresis as described in Example 10.

Following electrophoresis, RNA was blotted as described in Example 10 and a probe comprising clone nCfCLBP$_{340}$ labeled with $\alpha$-$^{32}$P-ATP was added to the buffer at a concentration of approximately 1×10$^6$ cpm/ml and allowed to hybridize for about 14 to 18 hours. The blot was then washed as described in Example 10 and exposed to film for autoradiography. Analysis of the developed film showed that there was greater expression of CLBP mRNA in HNC tissues compared to non-HNC tissues, indicating possible upregulation of CLBP in flea head and nerve cords.

The coding region of nCfCLBP2A$_{631}$, i.e. SEQ ID NO:162, was PCR amplified from the pBluescript™ clone described above as the template, using sense primer 2A1BamSen having nucleotide sequence 5' ATG GAT CCG GCA AAA TAT ACC AAA GAA GAA G 3', having a BamHI site indicated in bold, designated herein as SEQ ID NO:1952, and anti-sense primer 2AlantiR1, having nucleotide sequence 5' ATG AAT TCT TAT ATT GGT ATC GCG TCC ATT 3', having a EcoRI site indicated in bold, designated herein as SEQ ID NO:1953. PCR reactions were performed using the following thermocycling conditions: (a) one cycle at 95° C. for one minute; (b) five cycles at 94° C. for ten seconds, 49° C. for twenty-five seconds, and 69° C. for one minute; and (c) twenty-three cycles at 94° C. for ten seconds, 53° C. for twenty seconds, and 69° C. for seventy-five seconds, in reactions containing 0.2 mM dNTPs, 1 µM of each primer, 0.5 µl of 5U/µl KlenTaq Advantage polymerase, available from Clontech, 1 µl of 1 µg/µl template, and 1×KlenTaq buffer, hereinafter referred to as "standard PCR conditions". The PCR product was digested with BamHI and EcoRI and ligated into the vector pTrcHisB, available from Invitrogen, that had been digested with BamHI and EcoRI. The resulting recombinant molecule, referred to herein as pTrc-nCfCLBP2A$_{441}$, was transformed into *E. coli* strain BL21, available from Novagen Inc., Madison, Wis., to form recombinant cell *E. coli*:pTrc-nCfCLBP2A$_{441}$.

The recombinant cell was grown under standard conditions and then incubated in the presence of 0.5 µM isopropylthio-β-galactoside (IPTG) to induce expression of recombinant protein. Expression was confirmed using Coomassie-blue-stained Tris-glycine gel and by Western blot using a T7 tag antibody, available from Novagen, which showed expression of an about 18 kDa protein. The protein product was purified as follows. The recombinant cells were collected by centrifugation, the supernatant was discarded and the pellets were resuspended and homogenized in 60 ml (total) of 50 mM Tris pH8.0 containing 50 mM NaCl and 1 mM phenylmethylsulfonyl fluoride (PMSF). The sample was then passed through the microfluidizer five times, rocked at 4° C. for 20 minutes, and centrifuged at 20,000×G for 30 minutes. The supernatant was collected and filtered through a 0.45 µm filter then run over a HiTrap Chelating column, available from Amersham Pharmacia, in 50 mM Tris pH8 containing 50 mM NaCl and 10M immidazole and eluted with an increasing imidazole gradient. The recombinant protein was eluted at approximately 150 mM imidazole. Fractions containing recombinant protein were pooled and concentrated using a Centricon Plus-20 (Amicon), and diafiltered into PBS. Quantification of the protein was performed by densitometry against a known standard.

EXAMPLE 13

This Example describes the further characterization and expression of a Sodium/Hydrogen Transporter-like cDNA isolated by EST sequencing described in Example 1.

A cDNA designated clone 2231-94 was isolated from the unsubtracted HMT library as described in Example 1. Analysis of clone 2231-94 indicated that the cDNA, denoted nCfNAH$_{2080}$, is about 2080 nucleotides in length, having a coding strand with nucleic acid sequence SEQ ID NO:1867 and a complementary sequence having SEQ ID NO:1869. Translation of SEQ ID NO:1867 suggests that nucleic acid molecule nCfNAH$_{2080}$ encodes a full-length Sodium/Hydrogen Transporter-like protein of 608 amino acids, referred to herein as PCfNAH$_{608}$, having an amino acid sequence represented by SEQ ID NO:1868, assuming the initiation codon spans from nucleotide 45 through nucleotide 47 of SEQ ID NO:1867 and the termination codon spans from nucleotide 1869 through nucleotide 1871 of SEQ ID NO:1867. The coding region encoding PCfNAH$_{608}$, is represented by nucleic acid molecule nCfNAH$_{1824}$, having a coding strand with the nucleic acid sequence represented by SEQ ID NO:1870 and a complementary strand with nucleic acid sequence represented by SEQ ID NO:1871. The amino acid sequence of SEQ ID NO:1868, predicts that PCfNAH$_{608}$ has an estimated molecular weight of about 67.9 kDa and an estimated isoelectric point (pI) of about 6.47.

Comparison of amino acid sequence SEQ ID NO:1868 with amino acid sequences reported in GenBank indicates that SEQ ID NO:1868 showed the most homology, i.e., about 67.7% identity, with a sodium hydrogen exchanger NHE1 (Accession # AAD32689.1). Comparison of SEQ ID NO:1867 with nucleic acid sequences reported in GenBank indicates that SEQ ID NO:1867 showed the most homology, i.e., about 59.5% identity, with a *Drosophila melanogaster* sodium hydrogen exchanger NHE1 (Accession # AF142676). Percent identity calculations were performed using GCG version 9.0 using default parameters.

In order to express the full-length putative NaH protein, the entire coding region was amplified by PCR and then ligated into the InsectSelect™ expression vector pIB/V5-His, available from Invitrogen, as follows. Forward primer NaH-1S-FE, which corresponds to nucleotides 42-74 of SEQ ID NO:1867, having the sequence 5' GAC TAG TAA AAT GGG CGT TAA AAA TAT ATA TTT ATA CTG C 3', denoted SEQ ID NO:1939 and having a SpeI site indicated in bold, was used in conjunction with reverse primer NaH-1S-RE, which is complementary to nucleotides 1845-1867 of SEQ ID NO:1867, having the sequence 5' CCG CTC GAG GTA CTG CAC GTA CTA ACG TCA TC 3', denoted SEQ ID NO:1940 and having a XhoI restriction site indicated in bold, in a PCR reaction using SEQ ID NO:1867 as the template. Standard PCR reaction conditions were used with the following thermocycling conditions: (1) 94° C. for 30 seconds, (2) 25 cycles of 94° C. for 10 seconds, 55° C. for 10 seconds and 72° C. for 3 minutes. The products of this reaction were separated on a 1.5% agarose gel, and a band corresponding to an approximately 1825 nucleotide molecule was cut from the gel and purified using the QIAquick Gel Extraction Kit as described above. The PCR product was then digested with SpeI and XhoI restriction endonucleases for 18 hours at 37. The digestion product was purified using the QIAquick Nucleotide Removal Kit, available from Qiagen, and ligated into the vector pIB/V5-His which had also been digested with SpeI and XhoI and treated with shrimp alkaline phosphatase, available from New England BioLabs, Inc., for 30 minutes at 37°. Following standard transformation procedures, a bacterial clone containing the plasmid pIB/V5-His-NaH was isolated. DNA sequence analysis of the clone confirmed that nucleotides 42-1867 of SEQ ID NO:1867, referred to herein as nCfNAH$_{1826}$, had been successfully ligated into the pIB/V5-His expression vector in frame with the C-terminal V5 epitope encoded by the vector.

A Northern Blot analysis was conducted as described in Example 4 to determine whether NaH mRNA is expressed only in certain life stages of the flea life cycle and whether NaH mRNA is expressed only in HMT tissue. Total RNA was extracted from eggs, first, third, and wandering larvae, pupae, unfed adults, and adults fed on cat blood for 0.25, 2, 8, and 24 hours. In addition, total RNA was extracted from hindguts and Malpighian tubules extracted from 24 hour cat blood-fed adult fleas, and from the remaining body parts following the removal of hindguts and Malpighian tubules. Each RNA sample was separated by gel electrophoresis, transferred to nylon membranes and hybridized with α-$^{32}$P-ATP labeled nCfNAH$_{1826}$ under the Northern Blotting conditions described in Example 4. Analysis of the developed film revealed that NAH mRNA was expressed in the 0.25, 2, and 8 hour adult fed timepoints only.

EXAMPLE 14

This Example describes the further characterization of a Chloride Intracellular Channel-like cDNA isolated by EST sequencing described in Example 1.

A cDNA designated clone 2233-24 was isolated from the unsubtracted HMT library as described in Example 1. Analysis of clone 2233-24 indicated that the cDNA, denoted nCfCLIC$_{2283}$ is about 2283 nucleotides in length, having a coding strand with nucleic acid sequence SEQ ID NO:1872 and a complementary sequence having SEQ ID NO:1874. Translation of SEQ ID NO:1872 suggests that nucleic acid molecule nCfCLIC$_{2283}$ encodes a full-length Chloride Intracellular Channel-like protein of 262 amino acids, referred to herein as PCfCLIC$_{262}$, having an amino acid sequence represented by SEQ ID NO:1873, assuming the initiation codon spans from nucleotide 60 through nucleotide 62 of SEQ ID NO:1872 and the termination codon spans from nucleotide 846 through nucleotide 848 of SEQ ID NO:1872. The coding region encoding PCfCLIC$_{262}$, is represented by nucleic acid molecule nCfCLIC$_{786}$, having a coding strand with the nucleic acid sequence represented by SEQ ID NO:1875 and a complementary strand with nucleic acid sequence represented by SEQ ID NO:1876. The amino acid sequence of SEQ ID NO:1873, predicts that PCfCLIC$_{262}$ has an estimated molecular weight of about 30.2 kDa and an estimated isoelectric point (pI) of about 6.02.

Comparison of amino acid sequence SEQ ID NO:1873 with amino acid sequences reported in GenBank indicates that SEQ ID NO:1873 showed the most homology, i.e., about 37.8% identity, with a *Homo sapiens* chloride intracellular channel 2 (Accession # NP001280.1). Comparison of SEQ ID NO:1872 with nucleic acid sequences reported in GenBank indicates that SEQ ID NO:1872 showed the most homology, i.e., about 37.5% identity with a *Homo sapiens* chloride intracellular channel 2 (Accession # NM001289). Percent identity calculations were performed using GCG version 9.0 using default parameters.

EXAMPLE 15

This Example describes the further characterization of a Peritrophin-like cDNA, referred to herein as PL2, isolated by EST sequencing described in Example 1.

A cDNA designated clone 2232-23 was isolated from the unsubtracted HMT library as described in Example 1, denoted herein as SEQ ID NO:1877. Analysis of clone 2232-23 indicated that the cDNA, denoted nCfPL2$_{457}$ is about 457 nucleotides in length. Translation of the coding strand of nCfPL2$_{457}$ suggests that nucleic acid molecule nCfPL2$_{457}$ encodes a partial-length Peritrophin-like protein of 113 amino acids, referred to herein as PCfPL2$_{113}$, assuming a stop coding at nucleotides 342-344 of nCfPL2$_{457}$.

Additional coding sequence corresponding to the 5' end of nCfPL2$_{457}$ was isolated by PCR performed using a RACE cDNA pool prepared as described in Example 3 as template. A first PCR reaction was performed using reverse primer PL2-R1, which is complementary to nucleotides 167-187 of the nCfPL2$_{457}$ cDNA, having a nucleic acid sequence 5' GTC TGG AAG CTC AGG AAG AGG 3', denoted herein as SEQ ID NO:1941, in conjunction with forward Adapter Primer 1, SEQ ID NO:1933, described above under the following thermocycling conditions: (1) 94° C. for 30 seconds, (2) 5 cycles of 94° C. for 10 seconds and 72° C. for 4 minutes, (3) 5 cycles of 94° C. for 10 seconds and 70° C. for 4 minutes, and (4) 25 cycles of 94° C. for 10 seconds then 68° C. for 4 minutes. The product of this reaction was diluted 1:50 and used as template for a second PCR reaction as follows. Forward adapter primer 2, SEQ ID NO:1935, was used with reverse primer PL2-R2, which is complementary to nucleotides 29-52 of the nCfPL2$_{457}$ cDNA, having a nucleic acid sequence 5' GTA ATA TGC GTG ACA ATC GTG TGG 3', denoted herein as SEQ ID NO:1942, using the thermocycling conditions described for the first PCR reaction. The resulting product was gel purified as described above to reveal a distinct band corresponding to nucleic acid molecule of approximately 900 bp in length. The fragment was then ligated into the pCR II TA Cloning vector, available from Qiagen and sequenced using an ABI PRISM 377 automatic DNA Sequencer. Sequencing revealed that nucleotides 791-835 of the fragment had 100% identity with nucleotides 1-45 of the nCfPL2$_{457}$ cDNA. The two sequences were aligned to form a contiguous sequence, denoted nCfPL2$_{1291}$, which is about 1291 nucleotides in length, having a coding strand with nucleic acid sequence SEQ ID NO:1878 and a complementary sequence having SEQ ID NO:1879. Translation of SEQ ID NO:1878 suggests that nucleic acid molecule nCfPL2,29, encodes a non full-length Peritrophin-like protein of 391 amino acids.

In order to isolate the additional sequence corresponding to the 5' end of SEQ ID NO:1878, nested PCR reactions were performed using the RACE cDNA pool as template. For the first PCR, forward adapter primer AP1 was used with reverse primer PL2-R1 under standard PCR reaction conditions and the following thermocycling conditions: (1) 94° C. for 1 minute, (2) 5 cycles of 94° C. for 20 seconds and 70° C. for 1 minute, (3) 5 cycles of 94° C. for 20 seconds and 68° C. for 1 minute, (4) 10 cycles of 94° C. for 20 seconds and 66° C. for 1 minute. The products of this reaction were diluted 1:50 in water and used as template for the second, nested PCR. The second PCR reaction used forward adapter primer AP2 in conjunction with reverse primer PL2-R5, which is complementary to nucleotides 70-93 of SEQ ID NO:1878, having a nucleotide sequence 5' CGG TGC AAG TTA TAG AAC CTT CCG 3', denoted herein as SEQ ID NO:1943 under standard PCR reaction conditions using the following thermocycling conditions:

(1) 94° C. for 1 minute, (2) 5 cycles of 94° C. for 20 seconds and 70° C. for 1 minute, (3) 5 cycles of 94° C. for 20 seconds and 68° C. for 1 minute, (4) 40 cycles of 94° C. for 20 seconds and 66° C. for 1 minute. The products of this reaction were separated by agarose gel electrophoresis and a band approximately 279 nucleotides in length was excised from the gel and purified as described above. The fragment, referred to as nCfPL2$_{279}$, having a coding nucleic acid sequence designated SEQ ID NO:1880 and a complementary sequence designated SEQ ID NO:1881, was then ligated into the pCROII TA Cloning vector, available from Qiagen, and sequenced as described above. Sequencing revealed that nucleotides 228-279 of nCfPL2$_{279}$ were identical to nucleotides 42-93 of SEQ ID NO:1878, however, nucleotides 186-228 of nCfPL2$_{279}$ had no significant similarity to SEQ ID NO:1878. This discrepancy may be the result of alternative RNA splicing or may be an artifact of the cDNA pool. To determine the reason for this discrepancy, additional fragments corresponding to this region were isolated by PCR from flea cDNA libraries from adult midguts, hindgut and Malpighian tubules and mixed instar larvae using techniques described herein. Sequence analysis of fragments obtained from these libraries revealed that these fragments were identical in sequence to the sequence of nCfPL2$_{279}$, therefore, the region of SEQ ID NO:1878 which did not align to nCfPL2$_{279}$ was deemed to be an artifact and was not used in subsequent alignments.

The PL2 sequences described above were aligned to form a contiguous sequence, denoted nCfPL2$_{1477}$, which is about 1477 nucleotides in length, having a coding strand with nucleic acid sequence SEQ ID NO:1882 and a complementary sequence having SEQ ID NO:1884. Translation of SEQ ID NO:1882 suggests that nucleic acid molecule nCfPL2$_{1477}$ encodes a full-length Peritrophin-like protein of 453 amino acids, referred to herein as PCfPL2$_{453}$, having an amino acid sequence represented by SEQ ID NO:1883, assuming an initiation codon spanning from nucleotide 3 through nucleotide 5 of SEQ ID NO:1882 and a termination codon spanning from nucleotide 1362 through nucleotide 1364 of SEQ ID NO:1882. The coding region encoding PCfPL2$_{453}$, is represented by nucleic acid molecule nCfPL2$_{1359}$, having a coding strand with the nucleic acid sequence represented by SEQ ID NO:1885 and a complementary strand with nucleic acid sequence represented by SEQ ID NO:1886. The amino acid sequence of SEQ ID NO:1883, predicts that PCfPL2$_{453}$ has an estimated molecular weight of about 49 kDa and an estimated isoelectric point (pI) of about 4.7.

Comparison of amino acid sequence SEQ ID NO:1883 with amino acid sequences reported in GenBank indicates that SEQ ID NO:1883 showed the most homology, i.e., about 28% identity, with a *Drosophila melanogaster* locus AE003474 protein (Accession # AAF47629). Comparison of SEQ ID NO:1882 with nucleic acid sequences reported in GenBank indicates that SEQ ID NO:1882 showed the most homology, i.e., about 50% identity, *Penaeus semisulcatus* (a crustacean) peritrophin-like protein 1 cDNA (Accession # AP095580). Percent identity calculations were performed using GCG version 9.0 using default parameters.

EXAMPLE 16

This Example describes the further characterization and expression of a Peritrophin-like sequence cDNA, referred to herein as PL3, isolated by EST sequencing described in Example 1.

A cDNA designated clone 2240-17 was isolated from the unsubtracted HMT library as described in Example 1. Analysis of clone 2240-17 indicated that the cDNA, denoted nCfPL3$_{406}$, is about 406 nucleotides in length, having a coding strand with nucleic acid sequence SEQ ID NO:1887 and a complementary sequence having SEQ ID NO:1889. Translation of SEQ ID NO:1887 suggests that nucleic acid molecule nCfPL3$_{406}$ encodes a full-length Peritrophin-like protein of 81 amino acids, referred to herein as PCfPL3$_{81}$, having an amino acid sequence represented by SEQ ID NO:1888, assuming the initiation codon spans from nucleotide 20 through nucleotide 22 of SEQ ID NO:1887 and the termination codon spans from nucleotide 263 through nucleotide 265 of SEQ ID NO:1887. The coding region encoding PCfPL3$_{81}$, is represented by nucleic acid molecule nCfPL3$_{243}$, having a coding strand with the nucleic acid sequence represented by SEQ ID NO:1890 and a complementary strand with nucleic acid sequence represented by SEQ ID NO:1891. The amino acid sequence of SEQ ID NO:1888, predicts that PCfPL3$_{81}$ has an estimated molecular weight of about 9.1 kDa and an estimated isoelectric point (pI) of about 3.64.

Comparison of amino acid sequence SEQ ID NO:1888 with amino acid sequences reported in GenBank indicates that SEQ ID NO:1888 showed the most homology, i.e., about 34.2% identity, with a *Anopheles gambiae* peritrophin 1 protein (Accession # AAC39127). Comparison of SEQ ID NO:1887 with nucleic acid sequences reported in GenBank indicates that SEQ ID NO:1887 showed the most homology, i.e., about 37% identity, with a *Anopheles gambiae* chloride intracellular channel 2 (Accession # AF030431). Percent identity calculations were performed using GCG version 9.0 using default parameters.

In order to express the full-length putative PL3 protein, the entire coding region was amplified by PCR and then ligated into the *E. coli* expression vector pTrcHisB, available from Invitrogen, as follows. Forward primer PL3FE, which corresponds to nucleotides 70-93 of SEQ ID NO:1887, having the sequence 5' CGG GAT CCC GAA TAT GCT GAC GTA GAT GTG TG 3', denoted SEQ ID NO:1944, and having a BamHI restriction endonuclease site indicated in bold, was used in conjunction with reverse primer PL3RE, which is complementary to nucleotides 245-269 of SEQ ID NO:1887, having the sequence 5' GGA ATT CTG TTT TAT TCT GGT TGG TAA CAT TC 3', denoted herein as SEQ ID NO:1945 and having an EcoRI restriction endonuclease site indicated in bold, in a PCR reaction using SEQ ID NO:1887 as the template under standard PCR reaction conditions and the following thermocycling conditions: (1) 94° C. for 30 seconds, (2) 25 cycles of 94° C. for 10 seconds, 55° C. for 10 seconds and 72° C. for 3 minutes. The reaction product was separated on a 1.5% agarose gel, and a band corresponding to an approximately 200 nucleotide molecule, as visualized by agarose gel electrophoresis and ethidium bromide staining, was cut from the gel and purified using the QIAquick Gel Extraction Kit as described above.

The product of the PCR reaction was the digested with BamHI and EcoRI restriction endonucleases, available from New England BioLabs, Inc. for 18 hours at 37° C., purified using the QIAquick Nucleotide Removal Kit, available from Qiagen, and ligated into the vector pTrcHisB which had been similarly digested, treated with shrimp alkaline phosphatase, available from New England BioLabs, Inc., for 30 minutes at 37° C., and purified. Following standard transformation procedures into *E. coli* BL-21 competent cells, a bacterial clone containing the plasmid pTrcHisB-PL3 was isolated. DNA sequence analysis of the clone confirmed that 70-269 of SEQ ID NO:1887 had been successfully ligated into the pTrcHisB expression vector in frame with the N-terminal T7 Tag epitope encoded by the vector. The recombinant protein encoded thereby is predicted to be 97 amino acids in length and have a molecular mass of 10.9 kDa, including the T7 Tag and have a pI of 4.08.

A recombinant PL3 protein was expressed as follows. Five mls of Luria broth were innoculated with a glycerol stock of *E. coli* BL-21 competent cells, available from Novagen, Madison, Wis., that had been transformed with the pTrcHisB-PL3 plasmid prepared as described above and allowed to grow overnight at 37° C. under selection with 100 µg/ml ampicillin. A 1 ml aliquot of this culture was then used to inoculate 10 mls of fresh Luria broth containing 100 µg/ml ampicillin and the culture was allowed to grow to an approximate OD reading of 0.5. A 1 ml aliquot of the culture was removed, the cells were pelleted by centrifugation and the supernatant discarded. The cells were resuspended in a solution of 100 µl PBS and 100 µl of 2×SDS-PAGE loading buffer (100 mM Tris pH 6.8, 4% SDS, 20% glycerol, 0.02% bromophenol blue, and 10% 2-mercaptoethanol). Following removal of the 1 ml aliquot described above, IPTG was added to the remaining 9 ml culture to a final concentration of 5 mM of IPTG, the culture was incubated at 37° C. for an additional 60 minutes, 1 ml was removed and the OD measured at approximately 0.6. The cells in this 1 ml sample were then pelleted by centrifugation and resuspended in a solution of 120 µl of PBS and 120 µl of SDS-PAGE loading buffer. Equal volumes of the IPTG-induced and uninduced lysates were loaded onto a 14% Tris-Glycine SDS-PAGE gel, available from Novex, San Diego, Calif. Following electrophoresis, the proteins were transferred from the SDS-PAGE gel to a nitrocellulose membrane and a Western blot analysis was performed using the T7 tag antibody, available from Novagen, which revealed an approximately 18 kDa protein was induced by IPTG. The fact that the recombinant PL3 protein ran at a higher molecular weight than predicted is consistent with previous published results for other peritrophin proteins, and is thought to be due in part to the characteristically low pI of these proteins (Tellam et al., (1999) Peritrophic Matrix Proteins, Insect Biochemistry and Molecular Biology, 29:87-101). Sequence analysis of this protein indicates that it contained the N-terminal T7 Tag encoded by the vector.

Four flasks, each containing 1 liter of Luria broth with 100 µg/ml ampicillin were inoculated with a starter culture of 5 ml of *E. coli* BL-21 cells transformed with the pTrcHisB-PL3 plasmid as described above. The cultures were allowed to grow at 37° C. until the optical density reached approximately 0.500, at which time a 1 ml aliquot was removed from each flask as the pre-induction sample. IPTG was added to each 1 liter flask to a final concentration of 0.5 mM and the cultures allowed to grow at 37° C. for 135 additional minutes, at which time a 1 ml aliquot was removed from each flask as the post-induction sample. The 1 ml aliquots were centrifuged, the supernatants were discarded and the pellets were resuspended in 100 µl 2×SDS-PAGE loading buffer per each 0.5 optical density units measured. The pre-induction and post induction samples were then tested for recombinant PL3 protein expression using the standard Western blot techniques and the T7 Tag antibody described above. A protein running at approximately 18 kDa was detected in the post-induced but not in the pre-induced samples.

The cells from the remaining 4 liters of culture were centrifuged, the supernatants were discarded and the cell pellets were combined and resuspended in 120 mls of buffer A (50 mM Tris, PH 8.0, 20 mM NaCl, 1 mM phenylmethylsulfonyl fluoride (PMSF)). The sample was then passed through a microfluidizer five times then rocked at 4° C. for 20 minutes. The sample was then centrifuged for 30 minutes and the supernatant collected. Western blot analysis of the supernatant showed that the recombinant PL3 protein was soluble in the first buffer A extraction. The buffer A supernatant containing the recombinant PL3 protein was then further purified by a nickel column, a Q2 anion exchange chromatography column, and cation exchange chromatography, using techniques well known to those of skill in the art.

EXAMPLE 17

This Example describes the further characterization of a Peritrophin-like sequence cDNA, referred to herein as PL4, isolated by EST sequencing described in Example 1.

A cDNA designated clone 2244-71 was isolated from the unsubtracted HMT library as described in Example 1. Analysis of clone 2244-71 indicated that the cDNA, denoted $nCfPL4_{974}$, is about 974 nucleotides in length, having a coding strand with nucleic acid sequence SEQ ID NO:1892 and a complementary sequence having SEQ ID NO:1893. Translation of SEQ ID NO:1892 suggests that nucleic acid molecule $nCfPL4_{974}$ encodes a partial-length Peritrophin-like protein of 285 amino acids. Additional sequence corresponding to the 5' end was isolated by PCR using the RACE cDNA pool described in Example 3 as the template, as follows. Adapter Primer 1, i.e. SEQ ID NO:1933, was used as the forward primer in conjunction with reverse primer PL4-R1, which is complementary to nucleotides 229-251 of SEQ ID NO:1892, having a nucleic acid sequence 5' GAT ATC CAC TTT GAT CAG CGC AC 3', denoted herein as SEQ ID NO:1946 in a PCR reaction under standard PCR reaction conditions and the following thermocycling conditions: (1) 94° C. for 30 seconds, (2) 5 cycles of 94° C. for 10 seconds and 72° C. for 4 minutes, (3) 5 cycles of 94° C. for 10 seconds and 70° C. for 4 minutes, (4) 25 cycles of 94° C. for 10 seconds then 68° C. for 4 minutes. The products of this reaction were diluted 1:50 and used as template in a second PCR reaction using Adapter Primer 2, i.e. SEQ ID NO:1935 as the forward primer and reverse primer PL4-R2, which is complementary to nucleotides 58-78 of SEQ ID NO:1892, having a nucleic acid sequence 5' GGT ACT ACT CCT GGT GCG GGC 3', denoted herein as SEQ ID NO:1947, using the thermocycling conditions described for the first PCR reaction. The products of this reaction were gel purified as previously described and the fragment was ligated into the pCR II TA Cloning vector, available from Qiagen, and sequenced to reveal of fragment of approximately 150 nucleotides in length. Sequence analysis revealed that nucleotides 68-146 of the fragment had 100% identity with nucleotides 1-79 of $nCfPL4_{974}$. The two sequences were aligned to form a contiguous sequence of about 1043 nucleotides in length, referred to as $nCfPL4_{1043}$, having a coding strand with SEQ ID NO:1894 and a complementary strand having SEQ ID NO:1895. However, the contiguous sequence does not appear to encode a starting methionine in the predicted protein sequence, thus, a second attempt to isolate the remaining coding sequences at the 5' end was performed as follows. A first PCR reaction was performed with Adapter Primer 1 as the forward primer and PL4-R2 as the reverse primer using the RACE cDNA pool as the template under the thermocycling conditions described above. The products of this reaction were diluted 1:50 and used as the template in a second PCR reaction which used Adapter Primer 2 as the forward primer and reverse primer PL4-R4, which is complementary to nucleotides 58-80 of SEQ ID NO:1894, having the nucleic acid sequence 5' CCG TCG ACA TTA AAC TCA CCA TC 3', denoted SEQ ID NO:1948, under the thermocycling conditions described for the first PCR reaction. The products of this reaction were gel purified as previously described and the fragment was ligated into the pCR II TA Cloning vector, available from Qiagen, and sequenced to reveal of fragment of approximately 100 nucleotides in length. Sequence analysis revealed that nucleotides 21-101 of the fragment had 100% identity with nucleotides 1-81 of SEQ ID NO:1892. The two sequences were aligned to form a contiguous sequence that is 1062 nucleotides in length, referred to herein as $nCfPL4_{1062}$, having a coding strand with SEQ ID NO:1896 and a complementary strand with SEQ ID NO:1898. Translation of SEQ ID NO:1896 suggests that nucleic acid molecule $nCfPL4_{1062}$ encodes a full-length Peritrophin-like protein of 285 amino acids, referred to herein as $PCfPL4_{285}$, having an amino acid sequence represented by SEQ ID NO:1897, assuming the initiation codon spans from nucleotide 19 through nucleotide 21 of SEQ ID NO:1896 and the termination codon spans from nucleotide 874 through nucleotide 876 of SEQ ID NO:1896. The coding region encoding $PCfPL4_{285}$, is represented by nucleic acid molecule $nCfPL4_{855}$, having a coding strand with the nucleic acid sequence represented by SEQ ID NO:1899 and a complementary strand with nucleic acid sequence represented by SEQ ID NO:1900. The amino acid sequence of SEQ ID NO:1897, predicts that $PCfPL4_{285}$ has an estimated molecular weight of about 31.4 kDa and an estimated isoelectric point (pI) of about 6.99.

Comparison of amino acid sequence SEQ ID NO:1897 with amino acid sequences reported in GenBank indicates that SEQ ID NO:1897 showed the most homology, i.e., about 31.5% identity, with a *Drosophila melanogaster* Gasp precourser (Accession # AAD09748). Comparison of SEQ ID NO:1896 with nucleic acid sequences reported in GenBank indicates that SEQ ID NO:1896 showed the most homology, i.e., about 39.4% identity, with a *Drosophila melanogaster* Gasp precourser (Accession #AF070734). Percent identity calculations were performed using GCG version 9.0 using default parameters.

A Northern Blot analysis was conducted as described in Example 4 to determine whether PL4 mRNA is expressed only in certain life stages of the flea life cycle and whether PL4 mRNA is expressed only in HMT tissue. Total RNA was extracted from eggs, first, third, and wandering larvae, pupae, unfed adults, and adults fed on cat blood for 0.25, 2, 8, and 24 hours. In addition, total RNA was extracted from hindguts and Malpighian tubules extracted from 24 hour cat blood-fed adult fleas, and from the remaining body parts following the removal of hindguts and Malpighian tubules. Each RNA sample was separated by gel electrophoresis, transferred to nylon membranes and hybridized with $\alpha$-$^{32}$P-ATP labeled nCfPL4974 under the Northern Blotting conditions described in Example 4.

The results of the Northern blot assay are complex. Although stringent conditions were used, several bands with distinct expression patterns were seen. An approximately 1600 bp message was detected in the egg, first instar, third instar and wandering larval stages only. An approximately 1500 bp message was detected in all lifestages and adult fed timepoints, but with the strongest signals in the egg, first instar larval, and unfed adult stages. A third message, which ran approximately 1200 bp, was detected in the egg, first instar larval, pupal, and adult lifestages, including all unfed and fed adult timepoints. All three of the messages detected were seen only in the HMT tissues, and were not detected in the carcass tissues.

The detection of three mRNAs instead of one may be the result of the expression of three highly homologous transcripts. It has been reported in the literature that peritrophin gene families have been found that consist of a number of highly related genes (See Schorderet et al., 1998, cDNA and deduced amino acid sequences of a peritrophic membrane glycoprotein, 'peritrophin-48', from the larvae of *Lucilia cuprina* Insect Biochemistry and Molecular Biology 28, 99-111). It is possible that these transcripts represent the products of such a family or that the messages are the RNA products of alternative splicing of a single gene locus.

EXAMPLE 18

This Example describes the further characterization of a synaptic vesicle 2B-like sequence cDNA, isolated by EST sequencing described in Example 1.

A cDNA designated clone 2104-59 was isolated from the subtracted HMT library as described in Example 1, denoted herein as SEQ ID NO:358. DNA from clone 2104-59 was purified, and the insert used for plaque hybridization screening of the unsubtracted HMT cDNA library as follows. The insert from clone 2104-59 was excised by digestion with EcoRI, separated by agarose gel electrophoresis and purified using the QiaQuick Gel Extraction kit, available from Qiagen. A Megaprime DNA labeling kit, available from Amersham Pharmacia, was used to incorporate $\alpha$-$^{32}$P-labeled dATP into the random-primed probe mix. Hybridization and plaque purification were performed as previously described which resulted in the isolation of a clone containing an about 1875 nucleotide synaptic vesicle 2B-like sequence, referred to herein as nCfSVP$_{1875}$, having a coding strand with nucleic acid sequence SEQ ID NO:1901 and a complementary sequence having SEQ ID NO:1903. Translation of SEQ ID NO:1901 suggests that nucleic acid molecule nCfSVP$_{1875}$ encodes a full-length synaptic vesicle 2B-like protein of 530 amino acids, referred to herein as PCfSVP$_{530}$, having an amino acid sequence represented by SEQ ID NO:1902, assuming the initiation codon spans from nucleotide 44 through nucleotide 46 of SEQ ID NO:1901 and the termination codon spans from nucleotide 1634 through nucleotide 1636 of SEQ ID NO:1901. The coding region encoding PCfSVP$_{530}$, is represented by nucleic acid molecule nCfSVP$_{590}$, having a coding strand with the nucleic acid sequence represented by SEQ ID NO:1904 and a complementary strand with nucleic acid sequence represented by SEQ ID NO:1905. The amino acid sequence of SEQ ID NO:1902, predicts that PCfSVP$_{530}$ has an estimated molecular weight of about 58.7 kDa and an pI of about 7.61.

Comparison of amino acid sequence SEQ ID NO:1902 with amino acid sequences reported in GenBank indicates that SEQ ID NO:1902 showed the most homology, i.e., about 32% identity, with a *Drosophila melanogaster* BACR7A4.y (Accession # CAB51685). Comparison of SEQ ID NO:1901 with nucleic acid sequences reported in GenBank indicates that SEQ ID NO:1901 showed the most homology, i.e., about 39% identity, with a *Rattus norvegicus* synaptic vesicle protein 2B (SVP2B) mRNA (Accession # L10362). Percent identity calculations were performed using GCG version 9.0 using default parameters.

EXAMPLE 19

This Example describes the further characterization of a Voltage-Gated Chloride Channel-like sequence cDNA, isolated by EST sequencing described in Example 1.

A cDNA designated clone 2108-09 was isolated from the unsubtracted HMT library as described in Example 1. Analysis of clone 2108-09 indicated that the cDNA, denoted nCfVGCC$_{381}$, is about 381 nucleotides in length, having a coding strand with nucleic acid sequence SEQ ID NO:1906 and a complementary sequence having SEQ ID NO:1907. Translation of SEQ ID NO:1906 suggests that nucleic acid molecule nCfVGCC$_{38}$, encodes a partial-length Voltage-Gated Chloride Channel-like protein of 126 amino acids. Additional sequence corresponding to the 5' end was isolated by hybridization and PCR as follows.

The insert from clone 2108-09 was excised by digestion with EcoRI, separated by agarose gel electrophoresis and purified using the QiaQuick Gel Extraction kit, available from Qiagen. A Megaprime DNA labeling kit, available from Amersham Pharmacia, was used to incorporate $\alpha$-$^{32}$P-labeled dATP into the random-primed probe mix. Hybridization and plaque purification were performed on the unsubtracted HMT cDNA library as previously described which resulted in the isolation of a clone containing an about 2191 nucleotide VGCC-like sequence, referred to herein as nCfVGCC$_{2191}$, having a coding strand with nucleic acid sequence SEQ ID NO:1908 and a complementary sequence having SEQ ID NO:1909. Translation of SEQ ID NO:1908 suggests that nucleic acid molecule nCfVGCC$_{219}$, encodes a partial s VGCC-like protein of 595 amino acids.

In order to isolate the remaining coding regions at the 5' end, a PCR was performed using the RACE cDNA pool, prepared as described in Example 3, as the template as follows. Adapter Primer 1 was used as the forward primer in conjunction with reverse primer VGCC-R1, which is complementary to the nucleotides 1482-1503 of SEQ ID NO:1908, having a nucleic acid sequence 5' CGA TCA TGC GTC TAG CAT TGG C 3', denoted herein as SEQ ID NO:1949 under standard PCR reaction conditions and the following thermocycling conditions: (1) 94° C. for 30 seconds, (2) 5 cycles of 94° C. for 10 seconds and 72° C. for 4 minutes, (3) 5 cycles of 94° C. for 10 seconds and 70° C. for 4 minutes, (4) 25 cycles of 94° C. for 10 seconds and 68° C. for 4 minutes. The reaction products were separated on an agarose gel and a band corresponding to an approximately 1970 nucleotide molecule was isolated, purified using a Gel Purification Kit, available from Qiagen, ligated into the pCR II TA cloning vector, available from Invitrogen, and sequenced using an ABI PRISM 377 automatic DNA Sequencer. Sequence analysis revealed an approximately 1968 nucleotide fragment, referred to as nCfVGCC$_{1968}$, having a coding strand with SEQ ID NO:1910 and a complementary strand with SEQ ID NO:1911. Sequence analysis also revealed that nucleic acid molecule nCfVGCC$_{1968}$ does not encode a start codon, thus, a second 5' RACE PCR was performed as follows in order to isolate additional sequence. Adapter Primer 1 was used as the forward primer in conjunction with reverse primer VGCC-R4 primer which is complementary to nucleotides 350-372 of SEQ ID NO:1910, having a nucleic acid sequence 5' CCC GCC CCA GTT CTA GGT TGT CC 3', denoted herein as SEQ ID NO:1950, using the RACE cDNA pool prepared as described in Example 3 as the template, and the PCR reaction and thermocycling conditions as described for the first PCR reaction. The products of this reaction were then diluted 1:50 in water and used as the template in a second PCR reaction with Adapter Primer 2 as the forward primer in conjunction with reverse primer VGCC-R2, which is complementary to nucleotides 134-153 of SEQ ID NO:1910, having a nucleic acid sequence 5' CAC ACC CAA CCT GAC CAG GC 3', denoted herein as SEQ ID NO:1951, under the PCR reaction and thermocycling conditions as described for the first PCR reaction.

The products of this reaction were gel purified as previously described and the fragment was ligated into the pCR II TA Cloning vector, available from Qiagen, and sequenced to reveal of fragment of approximately 673 nucleotides in length, referred to herein as nCfVGCC$_{673}$, having a coding strand with SEQ ID NO:1912 and a complementary strand with SEQ ID NO:1913. Sequence analysis revealed that nucleotides 520-673 of the fragment had 100% identity with nucleotides 1-154 of SEQ ID NO:1910. The VGCC fragments were aligned to form a contiguous sequence that is 3126 nucleotides in length, referred to herein as nCfVGCC$_{3126}$, having a coding strand with SEQ ID NO:1914 and a complementary strand with SEQ ID NO:1916. Translation of SEQ ID NO:1914 suggests that nucleic acid molecule nCfVGCC$_{3126}$ encodes a full-length VGCC-like protein of 851 amino acids, referred to herein as PCfVGCC$_{851}$, having an amino acid sequence represented by SEQ ID NO:1915, assuming the initiation codon spans from nucleotide 168 through nucleotide 170 of SEQ ID NO:1914 and the termination codon spans from nucleotide 2721 through nucleotide 2723 of SEQ ID NO:1914. The coding region encoding PCfVGCC$_{851}$ is represented by nucleic acid molecule nCfVGCC$_{2553}$, having a coding strand with the nucleic acid sequence represented by SEQ ID NO:1917 and a complementary strand with nucleic acid sequence represented by SEQ ID NO:1918. The amino acid sequence of SEQ ID NO:1915, predicts that PCfVGCC$_{85}$, has an estimated molecular weight of about 93.4 kDa and an estimated pI of about 7.35.

Comparison of amino acid sequence SEQ ID NO:1915 with amino acid sequences reported in GenBank indicates that SEQ ID NO:1915 showed the most homology, i.e., about 63.1% identity, with a *Oryctolagus cuniculus* (rabbit) chloride channel protein 3 (CLCN3) (Accession # AAB95163). Comparison of SEQ ID NO:1914 with nucleic acid sequences reported in GenBank indicates that SEQ ID NO:1914 showed the most homology, i.e., about 61.3% identity, with a *Oryctolagus cuniculus* chloride channel protein 3 (CLCN3) mRNA (Accession # AF029348). Percent identity calculations were performed using GCG version 9.0 using default parameters.

A Northern Blot analysis was conducted as described in Example 4 to determine whether VGCC mRNA is expressed only in certain life stages of the flea life cycle and whether VGCC mRNA is expressed only in HMT tissue. Total RNA was extracted from eggs, first, third, and wandering larvae, pupae, unfed adults, and adults fed on cat blood for 0.25, 2, 8, and 24 hours. In addition, total RNA was extracted from hindguts and Malpighian tubules extracted from 24 hour cat blood-fed adult fleas, and from the remaining body parts following the removal of hindguts and Malpighian tubules. Each RNA sample was separated by gel electrophoresis, transferred to nylon membranes and hybridized with α-$^{32}$P-ATP labeled nCfVGCC$_{381}$ under the Northern Blotting conditions described in Example 4. An approximately 3 kB band was detected in all lifestages and adult unfed and fed timepoints, however, the intensity of the signal did vary between stages with the strongest signals seen in the egg, unfed adult, and 0.25 hour fed adult stages, and the weakest signals seen in the 3rd instar larval and pupal stages. A strong signal was detectable in the 24 hour fed adult HMT tissues, but only a very weak signal was present in the carcass tissues.

EXAMPLE 20

This Example describes the further characterization and expression of an Intersectin-like cDNA isolated by EST sequencing described in Example 2.

A cDNA designated clone 2225-23 was isolated from the unsubtracted HNC library as described in Example 2, denoted herein as SEQ ID NO:121. A Northern Blot analysis was conducted as described in Example 10 to determine whether clone 2225-23 mRNA is expressed exclusively in HNC tissues. For the hybridization step, a probe comprising the flea clone 2225-23 nucleic acid molecule was labeled with α-$^{32}$P-ATP using a DNA labeling kit, available from Amersham and added to the buffer at a concentration of approximately 1×10$^6$ cpm/ml, and allowed to hybridize for about 14 to 18 hours at 42° C. The blot was then washed twice for 10 minutes per wash in 0.5×SSPE and 0.1% sarcosyl at 55° C. and exposed to film for autoradiography. Analysis of the developed film showed that there was greater expression of clone 2225-23 mRNA in HNC tissues compared to non-HNC tissues, indicating possible upregulation of clone 2225-23 in flea head and nerve cords.

EXAMPLE 21

This Example describes the further characterization and expression of an Neuroendocrine Specific Protein C-like cDNA isolated by EST sequencing described in Example 2.

A cDNA designated clone 2249-19 was isolated from the unsubtracted HNC library as described in Example 2, denoted herein as SEQ ID NO:1775. A Northern Blot analysis was conducted as described in Example 10 to determine whether clone 2249-19 mRNA is expressed exclusively in HNC tissues. For the hybridization step, a probe having the nucleic acid sequence of clone 2249-19 was generated as follows. A PCR reaction was conducted using forward primer 2249-19for, having a nucleotide sequence 5' AGT CGC ATA GTG CAC TTC TGA ATG 3', denoted herein as SEQ ID NO:1954, and reverse primer 2249-19rev, having a nucleotide sequence 5' CTG ACA TCT GTT TCC ACA GCT C$_3$', denoted herein as SEQ ID NO:1955, using the HNC cDNA library prepared as described in Example 2 as the template under standard PCR reaction conditions and the following thermocycling conditions: (1) one minute at 95° C., (2) two cycles of 94° C. for 10 seconds, 50° C. for 20 seconds, and 72° C. for 20 seconds, (3) thirty cycles of 94° C. for 10 sec, 53° C. for 20 sec, 72° C. for 40 sec. The PCR product was ligated into the TA vector using a TA cloning kit, available from Invitrogen and the clone was digested with EcoRI enzyme, and purified from an agarose gel. The purified nucleic acid molecule was labeled with α-$^{32}$P-ATP using a DNA labeling kit, available from Amersham and added to the buffer at a concentration of approximately 1×10$^6$ cpm/ml, and allowed to hybridize for about 14 to 18 hours at 42° C. The blot was then washed twice for 10 minutes per wash in 0.5×SSPE and 0.1% sarcosyl at 55° C. and exposed to film for autoradiography. Analysis of the developed film showed that there was expression of clone 2249-19 mRNA in HNC tissues and non-HNC tissues with 2 bands evident; one at approximately 1.5 Kb and one at approximately 2.5 Kb.

EXAMPLE 22

This Example describes the further characterization and expression of an anoxia upregulated protein-like cDNA isolated by EST sequencing described in Example 2.

A TA clone from the HNC EST library described in Example 2 designated clone 2218-95, denoted herein as SEQ ID NO:1858 was sequenced using standard sequencing methods and shown to contain a non-full length nucleic acid molecule having significant homology to anoxia upregulated protein (AUP) genes. Additional sequence encoding an AUP gene was isolated as follows. A hybridization probe containing the nucleic acid sequence of SEQ ID NO:1858 was constructed as follows. A PCR reaction was conducted using forward primer 2218-95for, having a nucleotide sequence 5' AAT AGT GAT GTT GTA AGA GTT AGG 3', denoted herein as SEQ ID NO:1956, and reverse primer 2218-95rev, having a nucleotide sequence 5' GTT TAA TAT TGC ATG TTT ATT CAT TAA AA 3', denoted herein as SEQ ID NO:1957, using the HNC cDNA library prepared as described in Example 2 as the template under standard PCR reaction conditions and the following thermocycling conditions: (1) one minute at 95° C., (2) thirty cycles of 94° C. for 10 sec, 55° C. for 20 sec, 72° C. for 20 sec. The PCR product was ligated into the TA vector using a TA cloning kit, available from Invitrogen and the clone was digested with EcoRI enzyme, and purified from an agarose gel. The purified nucleic acid molecule was labeled with $\alpha$-$^{32}$P-ATP using a DNA labeling kit, available from Amersham.

The $^{32}$P $\alpha$-dATP labeled probe was used in a standard plaque lift hybridization procedure to isolate a clone from the HNC lambda-ZAP unsubtracted cDNA library described in Example 2. Hybridization was conducted as described in Example 12 and a plaque that hybridized strongly to the probe was isolated, purified and sequenced as described in Example 12. Sequencing revealed that the clone contained a nucleic acid molecule of about 1181 nucleotides, referred to herein as nCfAUP$_{1181}$, having a nucleotide sequence denoted herein as SEQ ID NO:1919. The complement of SEQ ID NO:1919 is represented herein as SEQ ID NO:1921.

Translation of SEQ ID NO:1919 suggests that nucleic acid molecule nCfAUP$_{1181}$ encodes a full-length AUP protein of 102 amino acids, referred to herein as PCfAUP$_{102}$, having an amino acid sequence represented by SEQ ID NO:1920, assuming the initiation codon spans from nucleotide 127 through nucleotide 129 of SEQ ID NO:1919 and the termination codon spans from nucleotide 433 through nucleotide 435 of SEQ ID NO:1919. The coding region encoding PCfAUP$_{102}$, is represented by nucleic acid molecule nCfAUP$_{306}$, having a coding strand with the nucleic acid sequence represented by SEQ ID NO:1922 and a complementary strand with nucleic acid sequence represented by SEQ ID NO:1923. The amino acid sequence of PCfAUP$_{102}$, predicts that PCfAUP$_{102}$ has an estimated molecular weight of about 11.9 kDa and an estimated pI of about 10.5.

Comparison of amino acid sequence SEQ ID NO:1920 with amino acid sequences reported in GenBank indicates that SEQ ID NO:1920 showed the most homology, i.e., about 52% identity, with a *Drosophila melanogaster* anoxia upregulated protein, GenBank Accession No. AAD38397. Percent identity calculations were performed using GCG version 9.0 using default parameters. Blast comparison of nucleic acid sequence SEQ ID NO:1919 with nucleic acid sequences reported in GenBank indicates that SEQ ID NO:1919 showed the most homology to a clone from human chromosome 14q31 region containing gene for neurexin III, GenBank #AC007056. Pairwise identity could not be performed as the human clone in GenBank is too large to load into GCG version 9.0.

EXAMPLE 23

This Example describes the further characterization of a neuroendocrine specific 7B2 polypeptide, isolated by EST sequencing described in Example 2.

A cDNA designated clone 2211-21 was isolated from the subtracted HNC library as described in Example 2, denoted herein as SEQ ID NO:92. DNA from clone 2211-21 was purified, and the insert used for plaque hybridization screening of the unsubtracted HMT cDNA library as follows. The insert from clone 2211-21 was excised by digestion with EcoRI, separated by agarose gel electrophoresis and purified using the QiaQuick Gel Extraction kit, available from Qiagen. A Megaprime DNA labeling kit, available from Amersham Pharmacia, was used to incorporate $\alpha$-$^{32}$P-labeled dATP into the random-primed probe mix. The $^{32}$P $\alpha$-dATP labeled probe was used in a standard plaque lift hybridization procedure to isolate a clone from the HNC lambda-ZAP unsubtracted cDNA library, prepared as described in Example 2. The following hybridization conditions were used. Hybond-N filters, available from Amersham, were hybridized with about 2×10$^6$ counts per minute (cpm) per ml of the probe in 50 ml of hybridization solution (5×SSPE, 25 mM EDTA pH 8.0, 5× Denhardt's reagent, 1.2% SDS, 0.020 mg/mL salmon sperm DNA) at 55° C. for about 48 hours. The filters were washed once in 50 mL 4×SSPE, 1% SDS for 15 minutes at 55° C., once in 50 mL 2×SSPE, 1% SDS for 10 minutes at 55° C., and washed twice in 50 mL 0.5×SSPE, 0.5% SDS for 10 minutes at 55° C. The filters were then subjected to autoradiography. One plaque that hybridized strongly to the probe was isolated and subjected to in vivo excision using the Stratagene Ex-Assist™ helper phage system and protocols. Miniprep DNA was prepared from the positive clone using a Miniprep kit and protocol, available from Qiagen, Chatsworth, Calif., and sequenced using standard sequencing procedures. The clone, referred to as nCf7B2$_{2161}$ contains a nucleic acid molecule of about 2161 nucleotides in length, having a coding strand with nucleic acid sequence SEQ ID NO:1924 and a complementary sequence having SEQ ID NO:1926.

Translation of SEQ ID NO:1924 suggests that nucleic acid molecule nCf7B2$_{216}$, encodes a full-length 7B2-like protein of 267 amino acids, referred to herein as PCf7B2$_{267}$, having an amino acid sequence represented by SEQ ID NO:1925, assuming the initiation codon spans from nucleotide 107 through nucleotide 109 of SEQ ID NO:1924 and the termination codon spans from nucleotide 908 through nucleotide 910 of SEQ ID NO:1924. The coding region encoding PCf7B2$_{267}$, is represented by nucleic acid molecule nCf7B2$_{801}$, having a coding strand with the nucleic acid sequence represented by SEQ ID NO:1927 and a complementary strand with nucleic acid sequence represented by SEQ ID NO:1928. The amino acid sequence of SEQ ID NO:1925, predicts that PCf7B2$_{267}$ has an estimated molecular weight of about 31 kDa and an estimated pI of about 5. Analysis of PCf7B2$_{267}$ suggests the presence of a signal peptide encoded by a stretch of amino acids spanning from about amino acid 1 through amino acid 20. The proposed mature protein, referred to herein as PCf7B2$_{247}$ contains 247 amino acids, designated SEQ ID NO:1930, and is encoded by a nucleic acid molecule referred to as nCf7B2$_{741}$, having a coding strand with SEQ ID NO:1929 and a complementary strand with SEQ ID NO:1931.

Comparison of amino acid sequence SEQ ID NO:1925 with amino acid sequences reported in GenBank indicates that SEQ ID NO:1925 showed the most homology, i.e., about 39% identity, with a *Drosophila melanogaster* protein, GenBank Accession No. AAF52036. Percent identity calculations were performed using GCG version 9.0 using default parameters. Blast comparison of nucleic acid sequence SEQ ID NO:1924 with nucleic acid sequences reported in GenBank indicates that SEQ ID NO:1924 showed the most homology to a human chromosome 19, cosmid R28204 clone, GenBank #Accession No. AC006132. Pairwise identity could not be performed as the human clone in GenBank is too large to load into GCG version 9.0, however, the BLAST score was 0.20, which is not considered to be significant level of identity.

A Northern Blot analysis was conducted as described in Example 10 to determine whether 7B2 mRNA is expressed exclusively in HNC tissues. For the hybridization step, a probe having the nucleic acid sequence of clone 2211-21 was generated as follows. A PCR reaction was conducted using forward primer 2211-21for, having a nucleotide sequence 5' GCG CCA TGA AGA TTT CAG GCG 3', denoted herein as SEQ ID NO:1958, and reverse primer 2211-21rev, having a nucleotide sequence 5' AAG TGC AAT GAA TCA TCA GCA AG 3', denoted herein as SEQ ID NO:1959, using the HNC cDNA library prepared as described in Example 2 as the template under standard PCR reaction conditions and the following thermocycling conditions: (1) one minute at 95° C., (2) five cycles of 94° C. for 10 seconds, 50° C. for 20 seconds, and 72° C. for 20 seconds, (3) thirty cycles of 94° C. for 10 sec, 53° C. for 20 sec, 72° C. for 40 sec. The PCR product was ligated into the TA vector using a TA cloning kit, available from Invitrogen and the clone was digested with EcoRI enzyme, and purified from an agarose gel. The purified nucleic acid molecule was labeled with $\alpha$-$^{32}$P-ATP using a DNA labeling kit, available from Amersham and added to the buffer at a concentration of approximately $1\times10^6$ cpm/ml, and allowed to hybridize for about 14 to 18 hours at 42° C. The blot was then washed twice for 10 minutes per wash in 0.5×SSPE and 0.1% sarcosyl at 55° C. and exposed to film for autoradiography. Analysis of the developed film showed that after 2.5 days of exposure clone 2211-21 mRNA was expressed exclusively in HNC tissue.

While various embodiments of the present invention have been described in detail, it is apparent that modifications and adaptations of those embodiments will occur to those skilled in the art. It is to be expressly understood, however, that such modifications and adaptations are within the scope of the present invention, as set forth in the following claims:

SEQUENCE LISTING (1959 sequences)

SEQ ID NO: 1 - DNA, 2057 bp, Ctenocephalides felis
  CDS (152)..(1303)
aacataataataacttaataaaattttgtgatcagatttctaatatccagaacaaagccagtaattataagaaccaagcctatttcatgtgaaggttacttctccacagtattattatctatctcaagaagtaatctattactgaatcaaaatgaaaagcagtacctgtatttttcttctggtcattatgctgaattgcaagaaccttgttaatgctgcgtgcaccaacaacgcgcctccaatgaagatattccgtagccgaagagttcttctcggtgatggtactgaaagagatgctggcattgtagttgattcctccggaagaataaaaagtataatttcaggagaagaagtggaaaggatagctaacgaaactaaagttgaggtgttggactacggtcaattttcaatatggccaggtgtgatagactctcatgtgcacgtcaacgaaccaggaagagaatcctgggaaggatacaccacagctactaaagcagcagcttggggcgggattaccacaatagtagacatgcctttgaattccatcccacctacaactactgtagagaatttgagaacaaaagtgaattcagcctgtggtaaaacgcatgttgatgtcgctttctggggaggcgtgattcctggcaatgcgcacgaattgttgccacttatcaacgccggagtaagaggattcaaatgttttacaagtgaaagtggtgtcgatgagtttccacaggttactaaaaatgatctggaaatggctctaaaagagctccagaaagcaaattccgtacttctgtaccatgccgaattacccgctcctcaagaaaatgttacaagcaatgaaactgaaaagtacatgacttacctgaaaacacgacctccaagtatggaagtaaatgctattgatatgattatagacctcacaaaaaaatataaagttaggtctcacatagtgcatctatcagcagcaggtgctttaccgcaattgaaaaaagcgcgctcagagaacgttccactttcgattgaaacttgtcatcattacttaacctttgctgctgaagatgttccagatggacatactgaatacaaatgcgctccaccaattagagaagaaagtaatcaagaaaaattatggcaagctttggaaaacagagatattgatatggtagtcagtgatcattctccatcacctgctgcactgaaaggcctgtgcaatggttgtcatcctgatttcctaaaagcttggggtggaattgctggtatgcagtttggattatctttaataagggaccggtgcttctaaaagaggctttaaagctcatgatgtatctcgtttattatctgcgggacctgcgaaattaactggactggatggcataaaaggacaaatcaaagaaggcttggatgctgatttagtaatttgggatcctgaggaagaatttaaggtcactaaagacataatccaacacaagaataaagaaacaccatacttaggaatgacgttgaagggcaaagttcatgcaactgttgtacgaggagactttgtttaccgtaatggacaaccattcgaaattccaaaaggaaatttacttattgaatgattaaatgtaatagattaatcaaattttagatgattaaaattgttttattactacaatagcaacctctgcctgaaaattaaccgaacaaacttctaacatccttattaatgtatagattttgaataataacatagaaattatactatttttttgatgactctaataaaaaaaatgtataaatggccatgcctgatatatttttgataaccttaatgaaaaaatgtttaaatggccatgtctgaaaagatttctatgtgtatttttttgttaacattttattgttgaatggataaaagataaatacaattttataagctgtttggataaattaattttgaataaatccataatcatagaatatgttaagtagcaaattaaaatatggaccacaaaccacaaaatgtatacgaaatataacttatatgatatatgaaaaaaaaaaaaaaaaaaaaa

SEQ ID NO: 2 - protein, 384 aa, Ctenocephalides felis
MKSSTCIFLLVIMLNCKNLVNAACTNNAPPMKIFRSRRVLLGDGTERDAGIVVDSSGRIKSIISGEEVERIANETKVEVLDYGQFSIWPGVIDSHVHVNEPGRESWEGYTTATKAAAWGGITTIVDMPLNSIPPTTTVENLRTKVNSACGKTHVDVAFWGGVIPGNAHELLPLINAGVRGFKCFTSESGVDEFPQVTKNDLEMALKELQKANSVLLYHAELPAPQENVTSNETEKYMTYLKTRPPSMEVNAIDMIIDLTKKYKVRSHIVHLSAAGALPQLKKARSENVPLSIETCHHYLTFAAEDVPDGHTEYKCAPPIREESNQEKLWQALENRDIDMVVSDHSPSPAALKGLCNGCHPDFLKAWGGIAGMQFGLSLIRDRCF

SEQ ID NO: 3 - DNA, 2057 bp, Ctenocephalides felis
tttttttttttttttttttttcatatatcatataagttatatttcgtatacattttgtggtttgtggtccatattttaatttgctacttaacatattctatgattatggatttattcaaaattaatttatccaaacagcttataaaattgtatttatcttttatccattcaacaataaaatgttaacaaaaaaatacacatagaaatcttttcagacatggccatttaaacattttttcattaaggttatcaaaaatatatcaggcatggccatttatacattttttttattagagtcatcaaaaaaatagtataatttctatgttattattcaaaatctatacattaataaggatgttagaagtttgttcggttaattttcaggcagaggttgctattgtagtaataaaacaattttaatcatctaaaatttgattaatctattacatttaatcattcaataagtaaatttccttttggaatttcgaatggttgtccattacggtaaacaaagtctcctcgtacaacagttgcatgaactttgcccttcaacgtcattcctaagtatggtgtttctttattcttgtgttggattatgtctttagtgaccttaaattcttcctcaggatcccaaattactaaatcagcatccaagccttctttgatttgtccttttatgccatccagtccagttaatttcgcaggtcccgcagataataaacgagatacatcatgagctttaaagcctcttttagaagcaccggtcccttattaaagataatccaaactgcataccagcaattccaccccaagcttttaggaaatcaggatgacaaccattgcacaggcctttcagtgcagcaggtgatggagaatgatcactgactaccatatcaatatctctgttttccaaagcttgccataatttttcttgattactttcttctctaattggtggagcgcatttgtattcagtatgtccatctggaacatcttcagcagcaaaggttaagtaatgatgacaagtttcaatcgaaagtggaacgttctctgagcgcgcttttttcaattgcggtaaagcacctgctgctgatagatgcactatgtgagacctaactttatatttttttgtgaggtctataatcatatcaatagcatttacttccatacttggaggtcgtgttttcaggtaagtcatgtacttttcagtttcattgcttgtaacattttcttgaggagcgggtaattcggcatggtacagaagtacggaatttgctttctggagctcttttagagccatttccagatcatttttagtaacctgtggaaactcatcgacaccactttcacttgtaaaacatttgaatcctcttactccggcgttgataagtggcaacaattcgtgcgcattgccaggaatcacgcctccccagaaagcgacatcaacatgcgttttaccacaggctgaattcacttttgttctcaaattctctacagtagttgtaggtgggatggaattcaaaggcatgtctactattgtggtaatcccgccccaagctgctgctttagtagctgtggtgtatccttcccaggattctcttcctggttcgttgacgtgcacatgagagtctatcacacctggccatattgaaaattgaccgtagtccaacacctcaactttagtttcgttagctatcctttccacttcttctcctgaaattatactttttattcttccggaggaatcaactacaatgccagcatctctttcagtaccatcaccgagaagaactcttcggctacggaatatcttcattggaggcgcgttgttggtgcacgcagcattaacaaggttcttgcaattcagcataatgaccagaagaaaaatacaggtactgcttttcattttgattcagtaatagattacttcttgagatagataataatactgtggagaagtaaccttcacatgaaataggcttggttcttataattactggctttgttctggatattagaaatctgatcacaaaattttattaagttattattatgtt

SEQ ID NO: 4 - DNA, 1152 bp, Ctenocephalides felis
  CDS (1)..(1152)
atgaaaagcagtacctgtatttttcttctggtcattatgctgaattgcaagaaccttgttaatgctgcgtgcaccaacaacgcgcctccaatgaagatattccgtagccgaagagttcttctcggtgatggtactgaaagagatgctggcattgtagttgattcctccggaagaataaaaagtataatttcaggagaagaagtggaaaggatagctaacgaaactaaagttgaggtgttggactacggtcaattttcaatatggccaggtgtgatagactctcatgtgcacgtcaacgaaccaggaagagaatcctgggaaggatacaccacagctactaaagcagcagcttggggcgggattaccacaatagtagacatgcctttgaattccatcccacctacaactactgtagagaatttgagaacaaaagtgaattcagcctgtggtaaaacgcatgttgatgtcgctttctggggaggcgtgattcctggcaatgcgcacgaattgttgccacttatcaacgccggagtaagaggattcaaatgttttacaagtgaaagtggtgtcgatgagtttccacaggttactaaaaatgatctggaaatggctctaaaagagctccagaaagcaaattccgtacttctgtaccatgccgaattacccgctcctcaagaaaatgttacaagcaatgaaactgaaaagtacatgacttacctgaaaacacgacctccaagtatggaagtaaatgctattgatatgattatagacctcacaaaaaaatataaagttaggtctcacatagtgcatctatcagcagcaggtgctttaccgcaattgaaaaaagcgcgctcagagaacgttccactttcgattgaaacttgtcatcattacttaacctttgctgctgaagatgttccagatggacatactgaatacaaatgcgctccaccaattagagaagaaagtaatcaagaaaaattatggcaagctttggaaaacagagatattgatatggtagtcagtgatcattctccatcacctgctgcactgaaaggcctgtgcaatggttgtcatcctgatttcctaaaagcttggggtggaattgctggtatgcagtttggattatctttaataagggaccggtgcttc

SEQ ID NO: 5 - protein, 384 aa, Ctenocephalides felis; identical to SEQ ID NO: 2

SEQ ID NO: 6 - DNA, 1152 bp, Ctenocephalides felis
gaagcaccggtcccttattaaagataatccaaactgcataccagcaattccaccccaagcttttaggaaatcaggatgacaaccattgcacaggcctttcagtgcagcaggtgatggagaatgatcactgactaccatatcaatatctctgttttccaaagcttgccataatttttcttgattactttcttctctaattggtggagcgcatttgtattcagtatgtccatctggaacatcttcagcagcaaaggttaagtaatgatgacaagtttcaatcgaaagtggaacgttctctgagcgcgcttttttcaattgcggtaaagcacctgctgctgatagatgcactatgtgagacctaactttatatttttttgtgaggtctataatcatatcaatagcatttacttccatacttggaggtcgtgttttcaggtaagtcatgtacttttcagtttcattgcttgtaacattttcttgaggagcgggtaattcggcatggtacagaagtacggaatttgctttctggagctcttttagagccatttccagatcatttttagtaacctgtggaaactcatcgacaccactttcacttgtaaaacatttgaatcctcttactccggcgttgataagtggcaacaattcgtgcgcattgccaggaatcacgcctccccagaaagcgacatcaacatgcgttttaccacaggctgaattcacttttgttctcaaattctctacagtagttgtaggtgggatggaattcaaaggcatgtctactattgtggtaatcccgccccaagctgctgctttagtagctgtggtgtatccttcccaggattctcttcctggttcgttgacgtgcacatgagagtctatcacacctggccatattgaaaattgaccgtagtccaacacctcaactttagtttcgttagctatcctttccacttcttctcctgaaattatactttttattcttccggaggaatcaactacaatgccagcatctctttcagtaccatcaccgagaagaactcttcggctacggaatatcttcattggaggcgcgttgttggtgcacgcagcattaacaaggttcttgcaattcagcataatgaccagaagaaaaatacaggtactgcttttcat

SEQ ID NO: 7 - DNA, 1128 bp, Ctenocephalides felis
  CDS (6)..(821)
tcacaatgaagttcttaggagctttattggttgcagtgtttgccttgggtgctgtggctgctgacaggaattcgcccacatatgtccgcggtttcccagtgggaagatccagagcacgaacaacatttggcaatgaagaaataaagtgtactaataagcagttgggaacattttgtcacgattgttctactttgaagttgtgcgctggacaagaaaccccaattacaacaatcaattgcagagactcaaattccgatgctccattttgtgtagatgatatgtgctcatcaaaacctggggaaaactgtaagacggcagaaactacatgcgccgttgtaggatatcagccagatccgaaagactgcacaagatacttattctgcaaagatggtaaaggtcaggttttcgaatgcccacctaactatgtatatgatcattctaaaaatatgtgtaaaaagaaatcgtcagaagctgattgcaccgtcatgaaatgcacaaatcccaattcttttataacctatgcaccggacccatcaatttatgcttggtgcaatgacaaattgcaaccgatcgtactgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtttaaaaattaaaatgtataaaattgtattttatgtaaggagcacaaacaaaatgtccttaactatagtaatttctgattatttaaaatatataaatatagaagctttatgaaattacatgtatctttttaataaaaataaatcgtttgggccgttnnaaaaaaaaaaaaaaaaaaaaaanaaaaaaa

SEQ ID NO: 8 - protein, 272 aa, Ctenocephalides felis
MKFLGALLVAVFALGAVAADRNSPTYVRGFPVGRSRARTTFGNEEIKCTNKQLGTFCHDCSTLKLCAGQETPITTINCRDSNSDAPFCVDDMCSSKPGENCKTAETTCAVVGYQPDPKDCTRYLFCKDGKGQVFECPPNYVYDHSKNMCKKKSSEADCTVMKCTNPNSFITYAPDPSIYAWCNDKLQPIVLKCEDDVNEWFDPKSFSCRTACKSENVFSDRRDCKKYYQCFLVNNKWQIKHYDCPNGLHFDKTELRCIPTPPGEECKSEIAK

SEQ ID NO: 9 - DNA, 1128 bp, Ctenocephalides felis
tttttttnttttttttttttttttttttttnnaacggcccaaacgatttatttttattaaaaagatacatgtaatttcataaagcttctatatttatatattttaaataatcagaaattactatagttaaggacattttgtttgtgctccttacataaaatacaattttatacattttaatttttaaacatattttttatatttaattgcacagatcatttgtgtatttattatattaattgactactttatgataatttgaatcctaattagtctattcaagattgttttcctggtttaagccttacttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcgatcggaaaaaacgttttcacttttgcatgcagttctgcacgagaaagattttgggtcaaaccattcgttgacgtcgtcttcacatttcagtacgatcggttgcaatttgtcattgcaccaagcataaattgatgggtccggtgcataggttataaaagaattgggatttgtgcatttcatgacggtgcaatcagcttctgacgatttctttttacacatatttttagaatgatcatatacatagttaggtgggcattcgaaaacctgacctttaccatctttgcagaataagtatcttgtgcagtctttcggatctggctgatatcctacaacggcgcatgtagtttctgccgtcttacagttttccccaggttttgatgagcacatatcatctacacaaaatggagcatcggaatttgagtctctgcaattgattgttgtaattggggtttcttgtccagcgcacaacttcaaagtagaacaatcgtgacaaaatgttcccaactgcttattagtacactttatttcttcattgccaaatgttgttcgtgctctggatcttcccactgggaaaccgcggacatatgtgggcgaattcctgtcagcagccacagcacccaaggcaaacactgcaaccaataaagctcctaagaacttcattgtga

SEQ ID NO: 10 - DNA, 816 bp, Ctenocephalides felis
  CDS (1)..(816)
atgaagttcttaggagctttattggttgcagtgtttgccttgggtgctgtggctgctgacaggaattcgcccacatatgtccgcggtttcccagtgggaagatccagagcacgaacaacatttggcaatgaagaaataaagtgtactaataagcagttgggaacattttgtcacgattgttctactttgaagttgtgcgctggacaagaaaccccaattacaacaatcaattgcagagactcaaattccgatgctccattttgtgtagatgatatgtgctcatcaaaacctggggaaaactgtaagacggcagaaactacatgcgccgttgtaggatatcagccagatccgaaagactgcacaagatacttattctgcaaagatggtaaaggtcaggttttcgaatgcccacctaactatgtatatgatcattctaaaaatatgtgtaaaaagaaatcgtcagaagctgattgcaccgtcatgaaatgcacaaatcccaattcttttataacctatgcaccggacccatcaatttatgcttggtgcaatgacaaattgcaaccgatcgtactgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaag

SEQ ID NO: 11 - protein, 272 aa, Ctenocephalides felis; identical to SEQ ID NO: 8

SEQ ID NO: 12 - DNA, 816 bp, Ctenocephalides felis
cttagcaatctcacttttgcattcttcgccgggtggcgtgggtatgcatcgcaactccgttttatcaaagtgcaagccatttggacaatcataatgttttatttgccatttgttgttaaccaagaaacattgataatattttttacaatctcttcgatcggaaaaaacgttttcacttttgcatgcagttctgcacgagaaagattttgggtcaaaccattcgttgacgtcgtcttcacatttcagtacgatcggttgcaatttgtcattgcaccaagcataaattgatgggtccggtgcataggttataaaagaattgggatttgtgcatttcatgacggtgcaatcagcttctgacgatttctttttacacatatttttagaatgatcatatacatagttaggtgggcattcgaaaacctgacctttaccatctttgcagaataagtatcttgtgcagtctttcggatctggctgatatcctacaacggcgcatgtagtttctgccgtcttacagttttccccaggttttgatgagcacatatcatctacacaaaatggagcatcggaatttgagtctctgcaattgattgttgtaattggggtttcttgtccagcgcacaacttcaaagtagaacaatcgtgacaaaatgttcccaactgcttattagtacactttatttcttcattgccaaatgttgttcgtgctctggatcttcccactgggaaaccgcggacatatgtgggcgaattcctgtcagcagccacagcacccaaggcaaacactgcaaccaataaagctcctaagaacttcat

SEQ ID NO: 13 - DNA, 1714 bp, Ctenocephalides felis
  CDS (294)..(1271)
atcgcaagtatcgggtgccgcgttcaaatttacacccggggcctcttcacgatttttctccgtgacacaaattatgaccagtgatccgaaacaaatctctacctgaactacccacatgttattcagtgaactaaacaaatttccttacccagaatacaacataagaactaacgatttgaactgtttataattcataatataaccgcatcttttatttctaattttatcttttagtgaataaatttatttgttgttgaataaattaataattgtgtacgttcaatttgttcgtgatggagaaaatagttggacgcgatggaacagaagtcatcacatacgagtttccatatatgaggagagcggataagcggactaactgggaaaagttccggcagggatgctacaatccggacgagggcagttttttgggcaggcaaccatcagcatgggctcgcgtatcgctattttacttggtattctacacagttttggcatccctattcacaatatgcatgtacacaatgctatctacgatagacaaggaatacccaaaatggcagcttgaggattcaataataggaactaatcctggactgggatttaggccaatagcagataacacagaagagggatctctaatatggttcgacgccaaaaatgaaactgaagttgcgaaatggacaacaataattgacgaatttttagctccttacaaaaatcggtctcaattgccaagccacggtgaaaatcaaatgttctgcgactacgaaacggggcccaacactgcaaatcgtgtttgtgccgtagccgtcgagaagtggggctcatgcacatcacaggctaactacggctttggacaatccgcaccttgtgtctttcttaagcttaacaggatatataattgggtaccagattattatgatgatgtggcgacgctgcctgaagatatgcctatggaattgaaggatcacatacaaagtctcaagccggatgagagaaaacaaatttgggtttcgtgtcaaggagaaaatccagttgatcgagaaaatttgggcccagttgaaatgtatccaagcatgggatttgctggatattattatccattcagaaaccaacgagattatcttagtccattagttgctgttcaattcaaaagacctacagtgggacgtttgatcaacgtggaatgtcgtgcctgggccaggaacatcatctatcgtggtggcaacaaggatcgacaaggatccgtccatttcgaactgatgattgattagaatcgacattattagtgttaattttactttattgatatcctaagcattatcgttctgtgttatcgcgccttgtacatcgttgcaaaatagctcgtacgtcgatgttgtgaatagaatttaagttttaattttaagtatgataattaatgaagtgtttaataaatcaaaatgaactttgagtataatagactttatatttatatctaaataaagtttacgcggttttgttatcattaaaggtgtaagattttaatatttataattgtttatatattagctataaatgtgtaaatatacgttatttaatatagtacaaaacaagttgatttatttaatgcctattgtgaaatatgttagtgtagtataaaatgcttatattttattatgtatttagaaaatatattacatttacttattactttaaaaaaaaaaaaaaaaaa

SEQ ID NO: 14 - protein, 326 aa, Ctenocephalides felis
MEKIVGRDGTEVITYEFPYMRRADKRTNWEKFRQGCYNPDEGSFLGRQPSAWARVSLFYLVFYTVLASLFTICMYTMLSTIDKEYPKWQLEDSIIGTNPGLGFRPIADNTEEGSLIWFDAKNETEVAKWTTIIDEFLAPYKNRSQLPSHGENQMFCDYETGPNTANRVCAVAVEKWGSCTSQANYGFGQSAPCVFLKLNRIYNWVPDYYDDVATLPEDMPMELKDHIQSLKPDERKQIWVSCQGENPVDRENLGPVEMYPSMGFAGYYYPFRNQRDYLSPLVAVQFKRPTVGRLINVECRAWARNIIYRGGNKDRQGSVHFELMID

SEQ ID NO: 15 - DNA, 1714 bp, Ctenocephalides felis
ttttttttttttttttttaaagtaataagtaaatgtaatatattttctaaatacataataaaatataagcattttatactacactaacatatttcacaataggcattaaataaatcaacttgttttgtactatattaaataacgtatatttacacatttatagctaatatataaacaattataaatattaaaatcttacacctttaatgataacaaaaccgcgtaaactttatttagatataaatataaagtctattatactcaaagttcattttgatttattaaacacttcattaattatcatacttaaaattaaaacttaaattctattcacaacatcgacgtacgagctattttgcaacgatgtacaaggcgcgataacacagaacgataatgcttaggatatcaataaagtaaaattaacactaataatgtcgattctaatcaatcatcagttcgaaatggacggatccttgtcgatccttgttgccaccacgatagatgatgttcctggcccaggcacgacattccacgttgatcaaacgtcccactgtaggtcttttgaattgaacagcaactaatggactaagataatctcgttggtttctgaatggataataatatccagcaaatcccatgcttggatacatttcaactgggcccaaattttctcgatcaactggattttctccttgacacgaaacccaaatttgttttctctcatccggcttgagactttgtatgtgatccttcaattccataggcatatcttcaggcagcgtcgccacatcatcataataatctggtacccaattatatatcctgttaagcttaagaaagacacaaggtgcggattgtccaaagccgtagttagcctgtgatgtgcatgagccccacttctcgacggctacggcacaaacacgatttgcagtgttgggccccgtttcgtagtcgcagaacatttgattttcaccgtggcttggcaattgagaccgatttttgtaaggagctaaaaattcgtcaattattgttgtccatttcgcaacttcagtttcatttttggcgtcgaaccatattagagatccctcttctgtgttatctgctattggcctaaatcccagtccaggattagttcctattattgaatcctcaagctgccattttgggtattccttgtctatcgtagatagcattgtgtacatgcatattgtgaatagggatgccaaaactgtgtagaataccaagtaaaatagcgatacgcgagcccatgctgatggttgcctgcccaaaaaactgccctcgtccggattgtagcatccctgccggaacttttcccagttagtccgcttatccgctctcctcatatatggaaactcgtatgtgatgacttctgttccatcgcgtccaactattttctccatcacgaacaaattgaacgtacacaattattaatttattcaacaacaaataaatttattcactaaaagataaaattagaaataaaagatgcggttatattatgaattataaacagttcaaatcgttagttcttatgttgtattctgggtaaggaaatttgtttagttcactgaataacatgtgggtagttcaggtagagatttgtttcggatcactggtcataatttgtgtcacggagaaaaatcgtgaagaggccccgggtgtaaatttgaacgcggcacccgatacttgcgat

SEQ ID NO: 16 - DNA, 978 bp, Ctenocephalides felis
  CDS (1)..(978)
atggagaaaatagttggacgcgatggaacagaagtcatcacatacgagtttccatatatgaggagagcggataagcggactaactgggaaaagttccggcagggatgctacaatccggacgagggcagttttttgggcaggcaaccatcagcatgggctcgcgtatcgctattttacttggtattctacacagttttggcatccctattcacaatatgcatgtacacaatgctatctacgatagacaaggaatacccaaaatggcagcttgaggattcaataataggaactaatcctggactgggatttaggccaatagcagataacacagaagagggatctctaatatggttcgacgccaaaaatgaaactgaagttgcgaaatggacaacaataattgacgaatttttagctccttacaaaaatcggtctcaattgccaagccacggtgaaaatcaaatgttctgcgactacgaaacggggcccaacactgcaaatcgtgtttgtgccgtagccgtcgagaagtggggctcatgcacatcacaggctaactacggctttggacaatccgcaccttgtgtctttcttaagcttaacaggatatataattgggtaccagattattatgatgatgtggcgacgctgcctgaagatatgcctatggaattgaaggatcacatacaaagtctcaagccggatgagagaaaacaaatttgggtttcgtgtcaaggagaaaatccagttgatcgagaaaatttgggcccagttgaaatgtatccaagcatgggatttgctggatattattatccattcagaaaccaacgagattatcttagtccattagttgctgttcaattcaaaagacctacagtgggacgtttgatcaacgtggaatgtcgtgcctgggccaggaacatcatctatcgtggtggcaacaaggatcgacaaggatccgtccatttcgaactgatgattgat

SEQ ID NO: 17 - protein, 326 aa, Ctenocephalides felis; identical to SEQ ID NO: 14

SEQ ID NO: 18 - DNA, 978 bp, Ctenocephalides felis
atcaatcatcagttcgaaatggacggatccttgtcgatccttgttgccaccacgatagatgatgttcctggcccaggcacgacattccacgttgatcaaacgtcccactgtaggtcttttgaattgaacagcaactaatggactaagataatctcgttggtttctgaatggataataatatccagcaaatcccatgcttggatacatttcaactgggcccaaattttctcgatcaactggattttctccttgacacgaaacccaaatttgttttctctcatccggcttgagactttgtatgtgatccttcaattccataggcatatcttcaggcagcgtcgccacatcatcataataatctggtacccaattatatatcctgttaagcttaagaaagacacaaggtgcggattgtccaaagccgtagttagcctgtgatgtgcatgagccccacttctcgacggctacggcacaaacacgatttgcagtgttgggccccgtttcgtagtcgcagaacatttgattttcaccgtggcttggcaattgagaccgatttttgtaaggagctaaaaattcgtcaattattgttgtccatttcgcaacttcagtttcatttttggcgtcgaaccatattagagatccctcttctgtgttatctgctattggcctaaatcccagtccaggattagttcctattattgaatcctcaagctgccattttgggtattccttgtctatcgtagatagcattgtgtacatgcatattgtgaatagggatgccaaaactgtgtagaataccaagtaaaatagcgatacgcgagcccatgctgatggttgcctgcccaaaaaactgccctcgtccggattgtagcatccctgccggaacttttcccagttagtccgcttatccgctctcctcatatatggaaactcgtatgtgatgacttctgttccatcgcgtccaactattttctccat

SEQ ID NO: 19 - DNA, 2240 bp, Ctenocephalides felis
  CDS (1)..(1707)
acaattttaaacgcatccacgaccgttgaaaaaaatcctggacatcaaaccagtatttcagaagaatctaccacaaaattggtaaaaacaaccactgaagacaaccacctcggtgtaaagagcctgaatgaacctggtgatgaacaagaattaaaaaaaccatcatcacatggtaaggagcatatttctttaccagtggcttcaccagtaccaccagtatcgcatatcttccaggctacaccaggagacctttgtccagccttcgacgatgcagatcgcttcacccagacagaacttttgtccaggctgacaaacgattgcaggtacgataagctggagcgccctttggggcctcacaatggtgcagggccgctcccggtggccgccagaatttacgtgtattttatacaaaatacggacgcgcacgaattgtcattttccgtgaccgtcctcctccaatttcgttacccaggacgccagattggcctacaaaaaagtggcacccacccaggacggtcatcatgggcgaatcgcagctcagggacaaaatctgggtacccacatgtattcgttgccaacgagagatcttcccaggttatgggcacagatgcccaatctaaggacatgttggtgtcagtagctcctgatggtacagtcgtcttttcggtcaggatgaaggcaactttgtactgttggatgaatttaaggaaatttccttttgatgaacaacagtgtcagatgatgttggaaagttggaagtacaatacaagtgaactcctattgacttgggaaccaactgcaccagtaactttagcaccagaactacatttgaccgaatatgtccttactgacatgtgggtaaatgaaacagttgtcaaggctgatttggatgacctgagacacggagcatttggtgggacatacagtgccttaagtttcacgattcaaataagtcgtgaaatgggttactatttaatggattactttttgccatcagtaatgatcgtgtcgtgttcctgggtaagtttttggctggcagcagaccaatcagcacccagagtcaccttaggtacaagcaccatgttatcatttatcactttagcaagtgcccaaggaaaaactttacccaaagtatcgtacatcaaagcttcagaaatctggtttttaggttgcaccgggtttatttttgggagtttagtggaattcgcgtttgtcaacacaatttggagacgaaggaaaaatgtggaattgaaaaaagtcaacagcaagtatattttgaagtcaactttgacgccgaggttggcccggaaggagtttcatgcttcgtttaattcgaatcctggaggtggtaataaggatgatcaggatttgggaagagggattagggtctttccgccgcctttggtcaaggctaggtcttgttccagtctggataggagtaatggatccgggaattttttgagcgtccatggaaatgatcacaaagttccaacaataacagcacaatgtgcagacgatgccgcaagtgaccagatttcagtttgtgtcgatggggaaaacgaagaacctgcacaaattgttcaccacacctggacgacgatgacacctcaagaaatttccatgtggattgacaaaaggtccagaatttgtttcccgatagcttttgctatatttaactttttttattggatatttgtttattatttataaacacacttaatatacttatagttttaataattaataaatttataaaataattaaaaataaatatatgtaaaatttaaaggaaacgtgaatagaatcaaaagagattcttattggattattccattattaataggattcttactagacaatattaatgattttatattatatatcacttataacttttgaacggtttgttaaaaatgaatacaatatttgacaaatttatataaaattaaacaatttataatattgtcgaacatcttaccaccctacagcgactcagtatactcgaaaatcgctattgaaatatcttacacaatttagtcattcctatttcacatataatagttaataattaaaattgaaattttaaattaaaaaataatgatactggaaattttaattttaattattaattattatatgaataattaattttactgcatagttataattataattataaatattaaatttttagaataaatactcagctggtctgaaaaaaaaaaaaaaaaaaaaaaaaa

SEQ ID NO: 20 - protein, 569 aa, Ctenocephalides felis
TILNASTTVEKNPGHQTSISEESTTKLVKTTTEDNHLGVKSLNEPGDEQELKKPSSHGKEHISLPVASPVPPVSHIFQATPGDLCPAFDDADRFTQTELLSRLTNDCRYDKLERPLGPHNGAGPLPVAARIYVYFIQNTDAHELSFSVTVLLQFRYPGRQIGLQKSGTHPGRSSWANRSSGTKSGYPHVFVANERSSQVMGTDAQSKDMLVSVAPDGTVVFSVRMKATLYCWMNLRKFPFDEQQCQMMLESWKYNTSELLLTWEPTAPVTLAPELHLTEYVLTDMWVNETVVKADLDDLRHGAFGGTYSALSFTIQISREMGYYLMDYFLPSVMIVSCSWVSFWLAADQSAPRVTLGTSTMLSFITLASAQGKTLPKVSYIKASEIWFLGCTGFIFGSLVEFAFVNTIWRRRKNVELKKVNSKYILKSTLTPRLARKEFHASFNSNPGGGNKDDQDLGRGIRVFPPPLVKARSCSSLDRSNGSGNFLSVHGNDHKVPTITAQCADDAASDQISVCVDGENEEPAQIVHHTWTTMTPQEISMWIDKRSRICFPIAFAIFNFFYWIFVYYL

SEQ ID NO: 21 - DNA, 2240 bp, Ctenocephalides felis
tttttttttttttttttttttttttcagaccagctgagtatttattctaaaaatttaatatttataattataattataactatgcagtaaaattaattattcatataataattaataattaaaattaaaatttccagtatcattattttttaatttaaaatttcaattttaattattaactattatatgtgaaataggaatgactaaattgtgtaagatatttcaatagcgattttcgagtatactgagtcgctgtagggtggtaagatgttcgacaatattataaattgtttaattttatataaatttgtcaaatattgtattcatttttaacaaaccgttcaaaagttataagtgatatataatataaaatcattaatattgtctagtaagaatcctattaataatggaataatccaataagaatctcttttgattctattcacgtttcctttaaattttacatatatttatttttaattattttataaatttattaattattaaaactataagtatattaagtgtgtttataaataataaacaaatatccaataaaaaaagttaaatatagcaaaagctatcgggaaacaaattctggaccttttgtcaatccacatggaaatttcttgaggtgtcatcgtcgtccaggtgtggtgaacaatttgtgcaggttcttcgttttccccatcgacacaaactgaaatctggtcacttgcggcatcgtctgcacattgtgctgttattgttggaactttgtgatcatttccatggacgctcaaaaaattcccggatccattactcctatccagactggaacaagacctagccttgaccaaaggcggcggaaagaccctaatccctcttcccaaatcctgatcatccttattaccacctccaggattcgaattaaacgaagcatgaaactccttccgggccaacctcggcgtcaaagttgacttcaaaatatacttgctgttgacttttttcaattccacatttttccttcgtctccaaattgtgttgacaaacgcgaattccactaaactcccaaaaataaacccggtgcaacctaaaaaccagatttctgaagctttgatgtacgatactttgggtaaagtttttccttgggcacttgctaaagtgataaatgataacatggtgcttgtacctaaggtgactctgggtgctgattggtctgctgccagccaaaaacttacccaggaacacgacacgatcattactgatggcaaaaagtaatccattaaatagtaacccatttcacgacttatttgaatcgtgaaacttaaggcactgtatgtcccaccaaatgctccgtgtctcaggtcatccaaatcagccttgacaactgtttcatttacccacatgtcagtaaggacatattcggtcaaatgtagttctggtgctaaagttactggtgcagttggttcccaagtcaataggagttcacttgtattgtacttccaactttccaacatcatctgacactgttgttcatcaaaaggaaatttccttaaattcatccaacagtacaaagttgccttcatcctgaccgaaaagacgactgtaccatcaggagctactgacaccaacatgtccttagattgggcatctgtgcccataacctgggaagatctctcgttggcaacgaatacatgtgggtacccagattttgtccctgagctgcgattcgcccatgatgaccgtcctgggtgggtgccacttttttgtaggccaatctggcgtcctgggtaacgaaattggaggaggacggtcacggaaaatgacaattcgtgcgcgtccgtattttgtataaaatacacgtaaattctggcggccaccgggagcggccctgcaccattgtgaggccccaaagggcgctccagcttatcgtacctgcaatcgtttgtcagcctggacaaaagttctgtctgggtgaagcgatctgcatcgtcgaaggctggacaaaggtctcctggtgtagcctggaagatatgcgatactggtggtactggtgaagccactggtaaagaaatatgctccttaccatgtgatgatggtttttttaattcttgttcatcaccaggttcattcaggctctttacaccgaggtggttgtcttcagtggttgtttttaccaattttgtggtagattcttctgaaatactggtttgatgtccaggatttttttcaacggtcgtggatgcgtttaaaattgt

SEQ ID NO: 22 - DNA, 1707 bp, Ctenocephalides felis
  CDS (1)..(1707)
acaattttaaacgcatccacgaccgttgaaaaaaatcctggacatcaaaccagtatttcagaagaatctaccacaaaattggtaaaaacaaccactgaagacaaccacctcggtgtaaagagcctgaatgaacctggtgatgaacaagaattaaaaaaaccatcatcacatggtaaggagcatatttctttaccagtggcttcaccagtaccaccagtatcgcatatcttccaggctacaccaggagacctttgtccagccttcgacgatgcagatcgcttcacccagacagaacttttgtccaggctgacaaacgattgcaggtacgataagctggagcgccctttggggcctcacaatggtgcagggccgctcccggtggccgccagaatttacgtgtattttatacaaaatacggacgcgcacgaattgtcattttccgtgaccgtcctcctccaatttcgttacccaggacgccagattggcctacaaaaaagtggcacccacccaggacggtcatcatgggcgaatcgcagctcagggacaaaatctgggtacccacatgtattcgttgccaacgagagatcttcccaggttatgggcacagatgcccaatctaaggacatgttggtgtcagtagctcctgatggtacagtcgtcttttcggtcaggatgaaggcaactttgtactgttggatgaatttaaggaaatttccttttgatgaacaacagtgtcagatgatgttggaaagttggaagtacaatacaagtgaactcctattgacttgggaaccaactgcaccagtaactttagcaccagaactacatttgaccgaatatgtccttactgacatgtgggtaaatgaaacagttgtcaaggctgatttggatgacctgagacacggagcatttggtgggacatacagtgccttaagtttcacgattcaaataagtcgtgaaatgggttactatttaatggattactttttgccatcagtaatgatcgtgtcgtgttcctgggtaagtttttggctggcagcagaccaatcagcacccagagtcaccttaggtacaagcaccatgttatcatttatcactttagcaagtgcccaaggaaaaactttacccaaagtatcgtacatcaaagcttcagaaatctggtttttaggttgcaccgggtttatttttgggagtttagtggaattcgcgtttgtcaacacaatttggagacgaaggaaaaatgtggaattgaaaaaagtcaacagcaagtatattttgaagtcaactttgacgccgaggttggcccggaaggagtttcatgcttcgtttaattcgaatcctggaggtggtaataaggatgatcaggatttgggaagagggattagggtctttccgccgcctttggtcaaggctaggtcttgttccagtctggataggagtaatggatccgggaattttttgagcgtccatggaaatgatcacaaagttccaacaataacagcacaatgtgcagacgatgccgcaagtgaccagatttcagtttgtgtcgatggggaaaacgaagaacctgcacaaattgttcaccacacctggacgacgatgacacctcaagaaatttccatgtggattgacaaaaggtccagaatttgtttcccgatagcttttgctatatttaactttttttattggatatttgtttattattta

SEQ ID NO: 23 - protein, 569 aa, Ctenocephalides felis; identical to SEQ ID NO: 20

SEQ ID NO: 24 - DNA, 1707 bp, Ctenocephalides felis
taaataataaacaaatatccaataaaaaaagttaaatatagcaaaagctatcgggaaacaaattctggaccttttgtcaatccacatggaaatttcttgaggtgtcatcgtcgtccaggtgtggtgaacaatttgtgcaggttcttcgttttccccatcgacacaaactgaaatctggtcacttgcggcatcgtctgcacattgtgctgttattgttggaactttgtgatcatttccatggacgctcaaaaaattcccggatccattactcctatccagactggaacaagacctagccttgaccaaaggcggcggaaagaccctaatccctcttcccaaatcctgatcatccttattaccacctccaggattcgaattaaacgaagcatgaaactccttccgggccaacctcggcgtcaaagttgacttcaaaatatacttgctgttgacttttttcaattccacatttttccttcgtctccaaattgtgttgacaaacgcgaattccactaaactcccaaaaataaacccggtgcaacctaaaaaccagatttctgaagctttgatgtacgatactttgggtaaagtttttccttgggcacttgctaaagtgataaatgataacatggtgcttgtacctaaggtgactctgggtgctgattggtctgctgccagccaaaaacttacccaggaacacgacacgatcattactgatggcaaaaagtaatccattaaatagtaacccatttcacgacttatttgaatcgtgaaacttaaggcactgtatgtcccaccaaatgctccgtgtctcaggtcatccaaatcagccttgacaactgtttcatttacccacatgtcagtaaggacatattcggtcaaatgtagttctggtgctaaagttactggtgcagttggttcccaagtcaataggagttcacttgtattgtacttccaactttccaacatcatctgacactgttgttcatcaaaaggaaatttccttaaattcatccaacagtacaaagttgccttcatcctgaccgaaaagacgactgtaccatcaggagctactgacaccaacatgtccttagattgggcatctgtgcccataacctgggaagatctctcgttggcaacgaatacatgtgggtacccagattttgtccctgagctgcgattcgcccatgatgaccgtcctgggtgggtgccacttttttgtaggccaatctggcgtcctgggtaacgaaattggaggaggacggtcacggaaaatgacaattcgtgcgcgtccgtattttgtataaaatacacgtaaattctggcggccaccgggagcggccctgcaccattgtgaggccccaaagggcgctccagcttatcgtacctgcaatcgtttgtcagcctggacaaaagttctgtctgggtgaagcgatctgcatcgtcgaaggctggacaaaggtctcctggtgtagcctggaagatatgcgatactggtggtactggtgaagccactggtaaagaaatatgctccttaccatgtgatgatggtttttttaattcttgttcatcaccaggttcattcaggctctttacaccgaggtggttgtcttcagtggttgtttttaccaattttgtggtagattcttctgaaatactggtttgatgtccaggatttttttcaacggtcgtggatgcgtttaaaattgt

SEQ ID NO: 25 - DNA, 1429 bp, Ctenocephalides felis
  CDS (18)..(1211)
gtttttgtgtgagcgtgatgtctccggctcttttagcggttattgctgtgattttgtgcattttatttagaattttaaatgtaaatacacaaccgggaacgcctaaaatatggtgcaaagatgagacgtttcttgaggccatttacaaaattgctccgcttttacgagagccttatgtgcctcctagactctggggattcagcgggcacgtgcagacgatcgtgcacagcatagtgggccgcgtcaagtgcccactgccactcggagagagggtgtacctgtcactggctgatgggtcgacgctcacttacgatctatacaaagctcttaatccggataaacatgaagatgaggtaactctggcagtgtgccctggcataagtaactcctcggagtcggtctacattcgcacatttgtccattacgcacaatattacggatacagatgtgccgtacttaatcatattggtgccttatctggagtgcctgtcactaactctagaaatttcagttatggtcataccgatgattataatgaaatgattcgacatctgcaatcacagtttcctccttctaaaataatttgtgtgggctacagtttaagaggcaatatcatcaccaaatatcttggtgaaaagacaaaaattaaaaatggtaatataattggaggaatttcaatatgccaaggatacaacgccattgagggtacgaaatggctactgaattggcaaaatttccgtcgtttctacttgtatgttttaacagaaagtgtaaagacaataattttgaaacacagacatattctcctgtccgatgaaatgaaattaaaatgccaattgaatgagagagatatagcatcggcagccactttgccggaattggatgacgcctatacgagaaaagttcacaagtttccatctgtaaacgctttgtacaaatggagttcctgcataaactacatccaggacattgaaactccaatggtgttcataaatgctaaagatgatcctctactccatgatacgcttctagaccctataagaaaaattgctggttcttctagaagaatgatctacgtagaactttctcatggaggtcatccaagattctttgaaaggggtctcatataccccaatcccgttacctggatagatagggcagtgataagcttggttggnggtctcctgcttgcacataatgaaaagagctattaaaccaatttagatttataattattatttataaaaatttatgaaatatttttttgttataaattgtggatttatttttttatttgtgctgtcttttgcatcttgtgctcagttattcgatgttattgaagttattttctaaatttatatatacgcggatgtgaagatcaatatatgtcataaagttaggggatttaggggaaaaaaaaaaaaaaaaa

SEQ ID NO: 26 - protein, 398 aa, Ctenocephalides felis
MSPALLAVIAVILCILFRILNVNTQPGTPKIWCKDETFLEAIYKIAPLLREPYVPPRLWGFSGHVQTIVHSIVGRVKCPLPLGERVYLSLADGSTLTYDLYKALNPDKHEDEVTLAVCPGISNSSESVYIRTFVHYAQYYGYRCAVLNHIGALSGVPVTNSRNFSYGHTDDYNEMIRHLQSQFPPSKIICVGYSLRGNIITKYLGEKTKIKNGNIIGGISICQGYNAIEGTKWLLNWQNFRRFYLYVLTESVKTIILKHRHILLSDEMKLKCQLNERDIASAATLPELDDAYTRKVHKFPSVNALYKWSSCINYIQDIETPMVFINAKDDPLLHDTLLDPIRKIAGSSRRMIYVELSHGGHPRFFERGLIYPNPVTWIDRAVISLVXGLLLAHNEKSY

SEQ ID NO: 27 - DNA, 1429 bp, Ctenocephalides felis
tttttttttttttttttcccctaaatcccctaactttatgacatatattgatcttcacatccgcgtatatataaatttagaaaataacttcaataacatcgaataactgagcacaagatgcaaaagacagcacaaataaaaaaataaatccacaatttataacaaaaaaatatttcataaatttttataaataataattataaatctaaattggtttaatagctcttttcattatgtgcaagcaggagaccnccaaccaagcttatcactgccctatctatccaggtaacgggattggggtatatgagacccctttcaaagaatcttggatgacctccatgagaaagttctacgtagatcattcttctagaagaaccagcaatttttcttatagggtctagaagcgtatcatggagtagaggatcatctttagcatttatgaacaccattggagtttcaatgtcctggatgtagtttatgcaggaactccatttgtacaaagcgtttacagatggaaacttgtgaacttttctcgtataggcgtcatccaattccggcaaagtggctgccgatgctatatctctctcattcaattggcattttaatttcatttcatcggacaggagaatatgtctgtgtttcaaaattattgtctttacactttctgttaaaacatacaagtagaaacgacggaaattttgccaattcagtagccatttcgtaccctcaatggcgttgtatccttggcatattgaaattcctccaattatattaccatttttaatttttgtcttttcaccaagatatttggtgatgatattgcctcttaaactgtagcccacacaaattattttagaaggaggaaactgtgattgcagatgtcgaatcatttcattataatcatcggtatgaccataactgaaatttctagagttagtgacaggcactccagataaggcaccaatatgattaagtacggcacatctgtatccgtaatattgtgcgtaatggacaaatgtgcgaatgtagaccgactccgaggagttacttatgccagggcacactgccagagttacctcatcttcatgtttatccggattaagagctttgtatagatcgtaagtgagcgtcgacccatcagccagtgacaggtacaccctctctccgagtggcagtgggcacttgacgcggcccactatgctgtgcacgatcgtctgcacgtgcccgctgaatccccagagtctaggaggcacataaggctctcgtaaaagcggagcaattttgtaaatggcctcaagaaacgtctcatctttgcaccatattttaggcgttcccggttgtgtatttacatttaaaattctaaataaaatgcacaaaatcacagcaataaccgctaaaagagccggagacatcacgctcacacaaaaac

SEQ ID NO: 28 - DNA, 1194 bp, Ctenocephalides felis
  CDS (1)..(1194)
atgtctccggctcttttagcggttattgctgtgattttgtgcattttatttagaattttaaatgtaaatacacaaccgggaacgcctaaaatatggtgcaaagatgagacgtttcttgaggccatttacaaaattgctccgcttttacgagagccttatgtgcctcctagactctggggattcagcgggcacgtgcagacgatcgtgcacagcatagtgggccgcgtcaagtgcccactgccactcggagagagggtgtacctgtcactggctgatgggtcgacgctcacttacgatctatacaaagctcttaatccggataaacatgaagatgaggtaactctggcagtgtgccctggcataagtaactcctcggagtcggtctacattcgcacatttgtccattacgcacaatattacggatacagatgtgccgtacttaatcatattggtgccttatctggagtgcctgtcactaactctagaaatttcagttatggtcataccgatgattataatgaaatgattcgacatctgcaatcacagtttcctccttctaaaataatttgtgtgggctacagtttaagaggcaatatcatcaccaaatatcttggtgaaaagacaaaaattaaaaatggtaatataattggaggaatttcaatatgccaaggatacaacgccattgagggtacgaaatggctactgaattggcaaaatttccgtcgtttctacttgtatgttttaacagaaagtgtaaagacaataattttgaaacacagacatattctcctgtccgatgaaatgaaattaaaatgccaattgaatgagagagatatagcatcggcagccactttgccggaattggatgacgcctatacgagaaaagttcacaagtttccatctgtaaacgctttgtacaaatggagttcctgcataaactacatccaggacattgaaactccaatggtgttcataaatgctaaagatgatcctctactccatgatacgcttctagaccctataagaaaaattgctggttcttctagaagaatgatctacgtagaactttctcatggaggtcatccaagattctttgaaaggggtctcatataccccaatcccgttacctggatagatagggcagtgataagcttggttggnggtctcctgcttgcacataatgaaaagagctat

SEQ ID NO: 29 - protein, 398 aa, Ctenocephalides felis; identical to SEQ ID NO: 26

SEQ ID NO: 30 - DNA, 1194 bp, Ctenocephalides felis
atagctcttttcattatgtgcaagcaggagaccnccaaccaagcttatcactgccctatctatccaggtaacgggattggggtatatgagacccctttcaaagaatcttggatgacctccatgagaaagttctacgtagatcattcttctagaagaaccagcaatttttcttatagggtctagaagcgtatcatggagtagaggatcatctttagcatttatgaacaccattggagtttcaatgtcctggatgtagtttatgcaggaactccatttgtacaaagcgtttacagatggaaacttgtgaacttttctcgtataggcgtcatccaattccggcaaagtggctgccgatgctatatctctctcattcaattggcattttaatttcatttcatcggacaggagaatatgtctgtgtttcaaaattattgtctttacactttctgttaaaacatacaagtagaaacgacggaaattttgccaattcagtagccatttcgtaccctcaatggcgttgtatccttggcatattgaaattcctccaattatattaccatttttaatttttgtcttttcaccaagatatttggtgatgatattgcctcttaaactgtagcccacacaaattattttagaaggaggaaactgtgattgcagatgtcgaatcatttcattataatcatcggtatgaccataactgaaatttctagagttagtgacaggcactccagataaggcaccaatatgattaagtacggcacatctgtatccgtaatattgtgcgtaatggacaaatgtgcgaatgtagaccgactccgaggagttacttatgccagggcacactgccagagttacctcatcttcatgtttatccggattaagagctttgtatagatcgtaagtgagcgtcgacccatcagccagtgacaggtacaccctctctccgagtggcagtgggcacttgacgcggcccactatgctgtgcacgatcgtctgcacgtgcccgctgaatccccagagtctaggaggcacataaggctctcgtaaaagcggagcaattttgtaaatggcctcaagaaacgtctcatctttgcaccatattttaggcgttcccggttgtgtatttacatttaaaattctaaataaaatgcacaaaatcacagcaataaccgctaaaagagccggagacat

SEQ ID NO: 31 - DNA, 765 bp, Ctenocephalides felis
  CDS (2)..(763)
tcacaatttgtatttgcatagtgcccttgtaaagtcgagagatgtcgacaggagaaacccggagaaagtgagagacgctaattattatttctttatcgaagcagcgattgcactatttatatctttcataataaatgtgttcgtagttgctgtgtttgcacatggtttatttaaaactactaaccaagaaatcttagacacttgcaaaagttcagccccatatatccgagaggaagccctaatagtctttaacaacaatactgaaattgtagaagccgatttgtacaaaggaggcatttatttaggctgtgccttcggggctgcagccgtgtacatttgggctgtcggaatattggcagccggtcaaagttctacaatgactgggacttatgctggtcaattcgccatggagggtttcctcaacctacaatggtctcgctggaagaggatcctattcacccgaatgattgccatcataccaacatttctgatggcatttttcaatagcatcgaagacctatcgggtatgaacgaccttctgaatgcagtgatgtccttacaactaccttttgcgaccctaccgactatagcgtttaccagcaatgctgctatcatgggagaattcgttaatggagcggttaattcagtcgttgcaatccttctatcgattttagtaattgcaatcaatatttattttgtggtcgaccaggttaataatggagacctgacggaaggctatttagctcttatagtgatatttggaat

SEQ ID NO: 32 - protein, 254 aa, Ctenocephalides felis
HNLYLHSALVKSRDVDRRNPEKVRDANYYFFIEAAIALFISFIINVFVVAVFAHGLFKTTNQEILDTCKSSAPYIREEALIVFNNNTEIVEADLYKGGIYLGCAFGAAAVYIWAVGILAAGQSSTMTGTYAGQFAMEGFLNLQWSRWKRILFTRMIAIIPTFLMAFFNSIEDLSGMNDLLNAVMSLQLPFATLPTIAFTSNAAIMGEFVNGAVNSVVAILLSILVIAINIYFVVDQVNNGDLTEGYLALIVIFG

SEQ ID NO: 33 - DNA, 765 bp, Ctenocephalides felis
attccaaatatcactataagagctaaatagccttccgtcaggtctccattattaacctggtcgaccacaaaataaatattgattgcaattactaaaatcgatagaaggattgcaacgactgaattaaccgctccattaacgaattctcccatgatagcagcattgctggtaaacgctatagtcggtagggtcgcaaaaggtagttgtaaggacatcactgcattcagaaggtcgttcatacccgataggtcttcgatgctattgaaaaatgccatcagaaatgttggtatgatggcaatcattcgggtgaataggatcctcttccagcgagaccattgtaggttgaggaaaccctccatggcgaattgaccagcataagtcccagtcattgtagaactttgaccggctgccaatattccgacagcccaaatgtacacggctgcagccccgaaggcacagcctaaataaatgcctcctttgtacaaatcggcttctacaatttcagtattgttgttaaagactattagggcttcctctcggatatatggggctgaacttttgcaagtgtctaagatttcttggttagtagttttaaataaaccatgtgcaaacacagcaactacgaacacatttattatgaaagatataaatagtgcaatcgctgcttcgataaagaaataataattagcgtctctcactttctccgggtttctcctgtcgacatctctcgactttacaagggcactatgcaaatacaaattgtga

SEQ ID NO: 34 - DNA, 762 bp, Ctenocephalides felis
  CDS (1)..(762)
cacaatttgtatttgcatagtgcccttgtaaagtcgagagatgtcgacaggagaaacccggagaaagtgagagacgctaattattatttctttatcgaagcagcgattgcactatttatatctttcataataaatgtgttcgtagttgctgtgtttgcacatggtttatttaaaactactaaccaagaaatcttagacacttgcaaaagttcagccccatatatccgagaggaagccctaatagtctttaacaacaatactgaaattgtagaagccgatttgtacaaaggaggcatttatttaggctgtgccttcggggctgcagccgtgtacatttgggctgtcggaatattggcagccggtcaaagttctacaatgactgggacttatgctggtcaattcgccatggagggtttcctcaacctacaatggtctcgctggaagaggatcctattcacccgaatgattgccatcataccaacatttctgatggcatttttcaatagcatcgaagacctatcgggtatgaacgaccttctgaatgcagtgatgtccttacaactaccttttgcgaccctaccgactatagcgtttaccagcaatgctgctatcatgggagaattcgttaatggagcggttaattcagtcgttgcaatccttctatcgattttagtaattgcaatcaatatttattttgtggtcgaccaggttaataatggagacctgacggaaggctatttagctcttatagtgatatttgga

SEQ ID NO: 35 - protein, 254 aa, Ctenocephalides felis; identical to SEQ ID NO: 32

SEQ ID NO: 36 - DNA, 762 bp, Ctenocephalides felis
tccaaatatcactataagagctaaatagccttccgtcaggtctccattattaacctggtcgaccacaaaataaatattgattgcaattactaaaatcgatagaaggattgcaacgactgaattaaccgctccattaacgaattctcccatgatagcagcattgctggtaaacgctatagtcggtagggtcgcaaaaggtagttgtaaggacatcactgcattcagaaggtcgttcatacccgataggtcttcgatgctattgaaaaatgccatcagaaatgttggtatgatggcaatcattcgggtgaataggatcctcttccagcgagaccattgtaggttgaggaaaccctccatggcgaattgaccagcataagtcccagtcattgtagaactttgaccggctgccaatattccgacagcccaaatgtacacggctgcagccccgaaggcacagcctaaataaatgcctcctttgtacaaatcggcttctacaatttcagtattgttgttaaagactattagggcttcctctcggatatatggggctgaacttttgcaagtgtctaagatttcttggttagtagttttaaataaaccatgtgcaaacacagcaactacgaacacatttattatgaaagatataaatagtgcaatcgctgcttcgataaagaaataataattagcgtctctcactttctccgggtttctcctgtcgacatctctcgactttacaagggcactatgcaaatacaaattgtg

SEQ ID NO: 37 - DNA, 604 bp, Ctenocephalides felis
  CDS (26)..(430)
tcaatactcttacttacagatcaaaatgagatccttcctcctcgctacattcgcagccttgttggtttgctctgtttttgctagacctcaagaagataaatatactagcaaatttgataacatcaatttagatgaaattttgcaaagcaatagattgctcaacaactatgtaaactgccttctcgacaaaggcagctgcacagcagaaggaaaagaattgaaaaaagtcttacctgatgccttatccaacgagtgcgctaaatgtagcgagaaacaaagagaaggagctgagaaagtaatcagatttttcgtcaacaacaaaccagaagagtggaagaaactttctgcagtttacgatccaaccggcgagtacacaaagaaatatagcacccaaattgaacaagtgaagagaggcgaacccgttacagtttaaatttccaaaaagagatttctcaaaatattggcaagtcatttaggaatcgtagtgttattttcacctgtagatatttctgtttttaataataaaaaaaatgtagttgtaggacaaatagagcatatttaaataaaaaaaaaaaaaaaaaaaaaaaaaaaaaaaaaaaaaaaa

SEQ ID NO: 38 - protein, 135 aa, Ctenocephalides felis
MRSFLLATFAALLVCSVFARPQEDKYTSKFDNINLDEILQSNRLLNNYVNCLLDKGSCTAEGKELKKVLPDALSNECAKCSEKQREGAEKVIRFFVNNKPEEWKKLSAVYDPTGEYTKKYSTQIEQVKRGEPVTV

SEQ ID NO: 39 - DNA, 604 bp, Ctenocephalides felis
ttttttttttttttttttttttttttttttttttttttttatttaaatatgctctatttgtcctacaactacattttttttattattaaaaacagaaatatctacaggtgaaaataacactacgattcctaaatgacttgccaatattttgagaaatctctttttggaaatttaaactgtaacgggttcgcctctcttcacttgttcaatttgggtgctatatttctttgtgtactcgccggttggatcgtaaactgcagaaagtttcttccactcttctggtttgttgttgacgaaaaatctgattactttctcagctccttctctttgtttctcgctacatttagcgcactcgttggataaggcatcaggtaagacttttttcaattcttttccttctgctgtgcagctgcctttgtcgagaaggcagtttacatagttgttgagcaatctattgctttgcaaaatttcatctaaattgatgttatcaaatttgctagtatatttatcttcttgaggtctagcaaaaacagagcaaaccaacaaggctgcgaatgtagcgaggaggaaggatctcattttgatctgtaagtaagagtattga

SEQ ID NO: 40 - DNA, 405 bp, Ctenocephalides felis
  CDS (1)..(405)
atgagatccttcctcctcgctacattcgcagccttgttggtttgctctgtttttgctagacctcaagaagataaatatactagcaaatttgataacatcaatttagatgaaattttgcaaagcaatagattgctcaacaactatgtaaactgccttctcgacaaaggcagctgcacagcagaaggaaaagaattgaaaaaagtcttacctgatgccttatccaacgagtgcgctaaatgtagcgagaaacaaagagaaggagctgagaaagtaatcagatttttcgtcaacaacaaaccagaagagtggaagaaactttctgcagtttacgatccaaccggcgagtacacaaagaaatatagcacccaaattgaacaagtgaagagaggcgaacccgttacagtt

SEQ ID NO: 41 - protein, 135 aa, Ctenocephalides felis; identical to SEQ ID NO: 38

SEQ ID NO: 42 - DNA, 405 bp, Ctenocephalides felis
aactgtaacgggttcgcctctcttcacttgttcaatttgggtgctatatttctttgtgtactcgccggttggatcgtaaactgcagaaagtttcttccactcttctggtttgttgttgacgaaaaatctgattactttctcagctccttctctttgtttctcgctacatttagcgcactcgttggataaggcatcaggtaagacttttttcaattcttttccttctgctgtgcagctgcctttgtcgagaaggcagtttacatagttgttgagcaatctattgctttgcaaaatttcatctaaattgatgttatcaaatttgctagtatatttatcttcttgaggtctagcaaaaacagagcaaaccaacaaggctgcgaatgtagcgaggaggaaggatctcat

SEQ ID NO: 43 - DNA, 1227 bp, Ctenocephalides felis
  CDS (312)..(1049)
gcgttttctaaaacaaacttctttataatgtaaataaatagaaatgaaatgtgaataaatttgagtatgaaaacaaattaatcaacaacacaatttaatttccttatttcatttataatgttggcattctaataaattaagttattatgagaaaacttcattacagtgatgtgtcaagctcctgtcaaaataaattgaaaatctgtttgtgataaaaattgttttttctataaaaatagcataatttaggaaactatatcgaaaaaataataaatttttaagtggccctttaatatcttctagaattaaatatggcaaccgtaccccttatgtttgctgaagatgacctagaaggtggtggaaaagaaggttcaatagagaatgactttgcatataacaataacgttattaatgcatctgttcgtgtgagacttggattcattcgaaaagtctatggactacttacagttcagttgttattgagcttgctggtgggcatagcctgccaaattgagcctgtacaaggaattgttaaagcaaatgactggctcgtattagtctgcatgatcagtagcattggtgtgctgattgctcttcacatcaagagaaaggaaacaccaactaattttattcttttaacaattttcacaattacaaactccatcagtgtgggtgtgctagtaacacattttaaagctagtttagtacttcaagctattgcaattactttgtgtgttgttattggtataacactctttacattacaaaacaaactggatttatcaatgctcccagcagcattgtttactggactttgctgtttattggtaggtggtatcattcagatattcactcattcaaccatttttgaattagtgttatgcagttttggtgcactaatattcagcttgtttttgctttatgacacgcatgttatgatgacgacattatcaccagaagagtatattttggccacaattaacttgtacttagatattgtcaatctattcatatatattttaagaattctgcaagcagcagacaggggttaaatcatctgtgataaaatataaatggttcaaaattctatattgtattatttatatatttaaaaatgccttgcttatttatattgtatgtttccatttattgtatatagtttattttgttattttatggccaagattaataaattcgaaattaatatgcaaaaaaaaaaaaaaaaaa

SEQ ID NO: 44 - protein, 246 aa, Ctenocephalides felis
MATVPLMFAEDDLEGGGKEGSIENDFAYNNNVINASVRVRLGFIRKVYGLLTVQLLLSLLVGIACQIEPVQGIVKANDWLVLVCMISSIGVLIALHIKRKETPTNFILLTIFTITNSISVGVLVTHFKASLVLQAIAITLCVVIGITLFTLQNKLDLSMLPAALFTGLCCLLVGGIIQIFTHSTIFELVLCSFGALIFSLFLLYDTHVMMTTLSPEEYILATINLYLDIVNLFIYILRILQAADRG

SEQ ID NO: 45 - DNA, 1227 bp, Ctenocephalides felis
ttttttttttttttttttgcatattaatttcgaatttattaatcttggccataaaataacaaaataaactatatacaataaatggaaacatacaatataaataagcaaggcatttttaaatatataaataatacaatatagaattttgaaccatttatattttatcacagatgatttaacccctgtctgctgcttgcagaattcttaaaatatatatgaatagattgacaatatctaagtacaagttaattgtggccaaaatatactcttctggtgataatgtcgtcatcataacatgcgtgtcataaagcaaaaacaagctgaatattagtgcaccaaaactgcataacactaattcaaaaatggttgaatgagtgaatatctgaatgataccacctaccaataaacagcaaagtccagtaaacaatgctgctgggagcattgataaatccagtttgttttgtaatgtaaagagtgttataccaataacaacacacaaagtaattgcaatagcttgaagtactaaactagctttaaaatgtgttactagcacacccacactgatggagtttgtaattgtgaaaattgttaaaagaataaaattagttggtgtttcctttctcttgatgtgaagagcaatcagcacaccaatgctactgatcatgcagactaatacgagccagtcatttgctttaacaattccttgtacaggctcaatttggcaggctatgcccaccagcaagctcaataacaactgaactgtaagtagtccatagacttttcgaatgaatccaagtctcacacgaacagatgcattaataacgttattgttatatgcaaagtcattctctattgaaccttcttttccaccaccttctaggtcatcttcagcaaacataaggggtacggttgccatatttaattctagaagatattaaagggccacttaaaaatttattattttttcgatatagtttcctaaattatgctatttttatagaaaaaacaatttttatcacaaacagattttcaatttattttgacaggagcttgacacatcactgtaatgaagttttctcataataacttaatttattagaatgccaacattataaatgaaataaggaaattaaattgtgttgttgattaatttgttttcatactcaaatttattcacatttcatttctatttatttacattataaagaagtttgttttagaaaacgc

SEQ ID NO: 46 - DNA, 738 bp, Ctenocephalides felis
  CDS (1)..(738)
atggcaaccgtaccccttatgtttgctgaagatgacctagaaggtggtggaaaagaaggttcaatagagaatgactttgcatataacaataacgttattaatgcatctgttcgtgtgagacttggattcattcgaaaagtctatggactacttacagttcagttgttattgagcttgctggtgggcatagcctgccaaattgagcctgtacaaggaattgttaaagcaaatgactggctcgtattagtctgcatgatcagtagcattggtgtgctgattgctcttcacatcaagagaaaggaaacaccaactaattttattcttttaacaattttcacaattacaaactccatcagtgtgggtgtgctagtaacacattttaaagctagtttagtacttcaagctattgcaattactttgtgtgttgttattggtataacactctttacattacaaaacaaactggatttatcaatgctcccagcagcattgtttactggactttgctgtttattggtaggtggtatcattcagatattcactcattcaaccatttttgaattagtgttatgcagttttggtgcactaatattcagcttgtttttgctttatgacacgcatgttatgatgacgacattatcaccagaagagtatattttggccacaattaacttgtacttagatattgtcaatctattcatatatattttaagaattctgcaagcagcagacaggggt

SEQ ID NO: 47 - protein, 246 aa, Ctenocephalides felis; identical to SEQ ID NO: 44

SEQ ID NO: 48 - DNA, 738 bp, Ctenocephalides felis
acccctgtctgctgcttgcagaattcttaaaatatatatgaatagattgacaatatctaagtacaagttaattgtggccaaaatatactcttctggtgataatgtcgtcatcataacatgcgtgtcataaagcaaaaacaagctgaatattagtgcaccaaaactgcataacactaattcaaaaatggttgaatgagtgaatatctgaatgataccacctaccaataaacagcaaagtccagtaaacaatgctgctgggagcattgataaatccagtttgttttgtaatgtaaagagtgttataccaataacaacacacaaagtaattgcaatagcttgaagtactaaactagctttaaaatgtgttactagcacacccacactgatggagtttgtaattgtgaaaattgttaaaagaataaaattagttggtgtttcctttctcttgatgtgaagagcaatcagcacaccaatgctactgatcatgcagactaatacgagccagtcatttgctttaacaattccttgtacaggctcaatttggcaggctatgcccaccagcaagctcaataacaactgaactgtaagtagtccatagacttttcgaatgaatccaagtctcacacgaacagatgcattaataacgttattgttatatgcaaagtcattctctattgaaccttcttttccaccaccttctaggtcatcttcagcaaacataaggggtacggttgccat

SEQ ID NO: 49 - DNA, 31 bp, Artificial Sequence
  Description of Artificial Sequence:  Synthetic Primer
gcggatcctatgctgaattgcaagaaccttg

SEQ ID NO: 50 - DNA, 30 bp, Artificial Sequence
  Description of Artificial Sequence:  Synthetic Primer
caggtaccctcttttagaagcaccggtccc

SEQ ID NO: 51 - DNA, 29 bp, Artificial Sequence
  Description of Artificial Sequence:  Synthetic Primer
cgggatcctgctgacaggaattcgcccac

SEQ ID NO: 52 - DNA, 31 bp, Artificial Sequence
  Description of Artificial Sequence: Synthetic Primer
catggtacccctggtttaagccttacttagc

SEQ ID NO: 53 - DNA, 23 bp, Artificial Sequence
  Description of Artificial Sequence:  Synthetic Primer
ccattattaacctggtcgaccac

SEQ ID NO: 54 - DNA, 18 bp, Artificial Sequence
  Description of Artificial Sequence:  Synthetic Primer
ggaaacagtatgaccatg

SEQ ID NO: 55 - DNA, 21 bp, Artificial Sequence
  Description of Artificial Sequence:  Synthetic Primer
cgctatagtcggtagggtcgc

SEQ ID NO: 56 - DNA, 20 bp, Artificial Sequence
  Description of Artificial Sequence:  Synthetic Primer
aattaaccctcactaaaggg

SEQ ID NO: 57 - DNA, 20 bp, Artificial Sequence
  Description of Artificial Sequence:  Synthetic Primer
caaaactggtctccccgctc

SEQ ID NO: 58 - DNA, 20 bp, Artificial Sequence
  Description of Artificial Sequence:  Synthetic Primer
taatacgactcactataggg

SEQ ID NO: 59 - DNA, 20 bp, Artificial Sequence
  Description of Artificial Sequence:  Synthetic Primer
ggttcgcctctcttcacttg

SEQ ID NO: 60 - DNA, 21 bp, Artificial Sequence
  Description of Artificial Sequence:  Synthetic Primer
cggttggatcgtaaactgcag

SEQ ID NO: 61 - DNA, 40 bp, Artificial Sequence
  Description of Artificial Sequence:  Synthetic Primer
cgcggatccagaagataaatatactagcaaatttgataac

SEQ ID NO: 62 - DNA, 37 bp, Artificial Sequence
  Description of Artificial Sequence:  Synthetic Primer
gaggaattcctctttttggaaatttaaactgtaacgg

SEQ ID NO: 63 - DNA, 500 bp, Ctenocephalides felis
accaggncgaataatatttctaattgtttcaatacaaactataaanggtattaaaattattggagttccttgaggcactagatgactaaatatatggttataattattaattcatcctantaatataaatcttaatcataaaggaagtcttaatcttaaagttaaagttaaatgactagttcttgtanaaatgtaattaaataatcctaaaaaattattaaataaaataaatgaaaataatctaataaatataaaagttcttcctataggattatattttataagtaatttaaattcattatgaagtgttataataatttttaatcaaattatgttgtatcgggacggaattattcanaatatatttggaataaataatantcctaatacctgccggnnntttgtntnntctctccnnctntccannctnatcncntncccntcnnnnntganatncntntnnnnnctntctcccctncntacnctgnnnctccnnnttc

SEQ ID NO: 64 - DNA, 164 bp, Ctenocephalides felis
gcagctaacaagaatgtattaactgcattccaaagaagaaattattctgatgaattatctttgacatttgctgctgccaataaggtattctatgactcagtagatgtaaagcaggtggatgttccatctttcagtggtgcttttggtatcttagctaaacacgt

SEQ ID NO: 65 - DNA, 337 bp, Ctenocephalides felis
cgcttccagttgacgtttcgtctcatgcaataattaattaaacttgtttgttagaggtgcaaaataaaattaaattaaaatgactgcctggagacaagctggtttaaactacattaacttttcaacaattgctgcccgaatggtccgccaagctttgaaatctgatctaaaaaatgaggctttgaaacgggacgtatctagcattaaattcacaccctggaaggacggaaaagcgatcactggaaaaccggaataaaatcaaatactcatctataaaagtgaaaccaagtaatcacaagatggaataatagacaattcactcaaattaataatgtgt

SEQ ID NO: 66 - DNA, 201 bp, Ctenocephalides felis
acaggccatttatgtgccagctgatgacttgacagatcctgcccctgccactacattcgctcacttggacgccaccactgtattgtcccgtgccattgctgaattaggtatctacccagctgtggatcctttggattctacatcccgtattatggaccccaacatcattggagctgaacattacaacattgcccgtggcgt

SEQ ID NO: 67 - DNA, 179 bp, Ctenocephalides felis
accttgagacttttggcagctaacaagaatgtattaactgcattccaaagaagaaattattctgatgaattatctttgacatttgctgctgccaataaggtattctatgactcagtagatgtaaagcaggtggatgttccatctttcagtggtgcttttggtatcttagctaaacacgt

SEQ ID NO: 68 - DNA, 500 bp, Ctenocephalides felis
acaccatcattgtatcagccactgcttctgatgctgcccctcttcaatatcttgctccatactctggatgtgctatgggtgaattcttccgtgacaatggaaaacatgctttgatcatctatgatgatttatccaaacaagctgttgcttatcgtcaaatgtctctattgttacgtcgtccaccaggtcgtgaggcttatccaggtgatgtcttctaccttcactcacgtctacttgaacgtgccgctaaaatgtctgaagctcatggaggtggctctttgactgctttgccagttattgaaacacaagctggtgacgtatcagcttatattccaactaatgtcatttccattactgatggcaaatcttcttggaaactgaattgttctacaagggtattcgaccagccatcaatgtaggtttatctgtatctcgtgtaggtctgctgcacaaaccaaagccatgaaacaggttgccggttcatgaaactggaattagct

SEQ ID NO: 69 - DNA, 549 bp, Ctenocephalides felis
tacataatggcatctttgaagttaaatatcgtaaccaggagcttaagctcatctgcagtcgcgtctcaaatggttaaaccacccgtacaagtatatggaattgagggtagatacgcaactgccttgtactcaggagccagtaagaataaagtactcgacgccgtcgagaaagatttggtcaaaatacagaataacttaaagaccgatgtaaaattccgcgatttcattgccaatccaacattcaagcgctcaattaaatcaaatgcattgaaggaagccagcagcaagctgcaaatggctccagctacttctaacttgttggagttacttgctgagaatggacgtttaaataaactggaaggtgttatcaacgcttataaagttatgatgtctgctcatcgtggagaggttccatgtgaagttacaacagctaaacctttagatgagaatcaacgaaaacaacttgaaagcctttaagaggattcttaaaacccaaagaaaacttattactacccttaagtaatcctcatcttggtggaatgtcgntca

SEQ ID NO: 70 - DNA, 238 bp, Ctenocephalides felis
actgctgatccctgtccctcgccccagcataataccattaggttgaaacgtccatttcctgcgtccaccagattgcgagtgtaacggtaacgatcaaatttggcataccgcctccactcggctggatccgacttgtagctcagcatcagatgattgaccaactcgatgtctacatcatcttcagcaaatgcttcgtgcaactgttcaactagatcttttagagaagtaacaccttggt

SEQ ID NO: 71 - DNA, 500 bp, Ctenocephalides felis
actaatgacaaggctggtggtccccattatgtcttgcgctggactactcctcaatctatcaaggagacatttgttccaatcacatgtgtcgactatccatacatgagagaataagctgccaaatcccccccaaagcacccacaccataacaataattcaatggacactaaaccaaagatgcgtgttacaaatactctgttcaagatctcgatcataaaatttgcacacagtccggttcacttttgatttctgttattcagtaactattttatctttaccgcgcacttggaaaataacaggtgaatcaaagaaattgattttagtaattatttttcttgttatataaataaaagaatattatagtaacattttgccattaaaaatattaattttacctaggaagcaatatcaagtattcattcaagtcaaatttgaagacatttattaaaaatcgatgttgccattttattaaatagattatgaaaattatgggggtatta

SEQ ID NO: 72 - DNA, 500 bp, Ctenocephalides felis
acatataatattgataatatgcatagggcggattttcagtgtctgtccattcttctggtgtcggaacatccttatcgaataatggattttcgggtttactttcatcatccaccgagtcaaaacctatcacgaactgaagaaacttgtgtagttcaggatgcgattgtggatcattcgtaacttcaaataatggcaaatagatatttgtaagaatttcttggaaattgttcatcagcttatttaatttgaaaatatcgtataatcgtggtatttgaataagccagcgcacattatcactataaacattagattctattgcccattttgcaagtttatcccactcttcaggacttttaccataaattgaaagtctcaattcgcaattttgatatttgctttcttctaaatccgaactaacttcattgataattcttgcaaaatattttccgttcaagtagttatcggttttaagaaacttctctcaatctgctttcaccaat

SEQ ID NO: 73 - DNA, 500 bp, Ctenocephalides felis
actaattaattttaaaaaattaaggatagaaaccaacctggcttaaaccggtttgaactcagannatgtaagaattaatggtcgaacagaccaaattttaaaacttctgcattttaaaattatcttaatccaacatcgaggtcgcaatctattttgtcgatatgttctcttaaaaataattacgctgttatcccttaagtaacttaatcttttaatcataatttatggatcaattattcaattatttatgttttaataaaaaaaaagttttataaattttcctatcaccccaataaaatatattaatataaataaatttaataatattcttaaaattaatctatatttatatataaaactttaaagggtcttctcgtcctttaataatatttacgctttttaacataaaaattaaattctataacaattttattaagacaggtaatattcattcaatcattcattccagcttcaattaaaaaactatggattatgctacc

SEQ ID NO: 74 - DNA, 500 bp, Ctenocephalides felis
ccttatgatattcataaatctaaaccacagtnnntttttcttgcactttgtgcaaaactatattccagtgttgtctgcctttgacacagctcaacattttgttgcattttgcaatctttcactaatatctgcccagttggcaacatcgaaaattgcttttacatagtcagccctgacatttttatattgaaggtagtatgcatgttcccagacgtcaattccaaatagtggaaccagaccagtggttgcttccaatggatcttgatttgcgcatgtagctatttgtaactttttagcagttttattataagccagccatccccatcctgagccttgaacacctacagctgctgtagacaaagcagttttcatcttatccatagatccaaaatcacattcaatcattttctgtagctggtcacttggtttaccccccttcggggaaaggtttttccaaaagatagaatgattgatgtgcctcctccattgaatttcaatgc

SEQ ID NO: 75 - DNA, 348 bp, Ctenocephalides felis
cagtgacgaaaagcaagtgccattatcgttctctccgtcgatttacgaaactacacttcaattccaaaaaggataactgggactcgcattccgactcactacccaacgactacgatttaattagctaaaggccaaattaaagcttcaagatgccgttcaagccagtagaaaacccaaaatgcccaaaatgcggcaaatcagtatatgccgccgaagagcgtgttgccggtggacttaagtggcacaaaatgtgtttcaaatgcggtatgtgcagcaaattgttggactccaccaactgcactgagcacgaaggtgagttgttctgcaagaactgccacgcccgcaagt

SEQ ID NO: 76 - DNA, 451 bp, Ctenocephalides felis
actatatataatatatatcgattttctatattagtcaaatatatgtgttaagcatttttttagagcattcctatttaaaaataaaatgttacgtcaaatttgaaaattccaagtaaaaaaatagtttttttctatatttgaattttgatcgttgtattactacgaatgttgccttgagatgtgcgttctattttgtagaataaatatcattcgtaatgaattaattcgcgtttaagccctgtttttggcgcagtccgggcatataatgtcggcgccgtctgtgatgaagccacggccgactagagaagctttgcatgacgcgcaggtgaagcagtcattgtgccaatggcgatcttcaaacgagatgaagcgagtgccaccaattcctgtaatgggtttggtgcaagccgtgcatctcttagcaaacaattcaccgaacattcagcacagt

SEQ ID NO: 77 - DNA, 500 bp, Ctenocephalides felis
accacatatgacttcaatgggacttggtaatggaggctcttcactcacttcggggcaaaacatatcttctgngggatcactgccaaattctattgaaacttgtaaatccaatctacctcacaataattctgcacaaacaccagaaaatccttacgtttatgatacagtaacttctaattatagccaaccaccagtaacttcatcaccatatgcaccagtagaacctaagagagcgcagggacatccattaaaaagtttcagtgttccggcaccacccacatcatcaactccaaatactcctaacaccaagcataatgcttcccaaggtattaatcgaccacaaaatgcatcaccatataaaaaacctttaatgattaatagactgcaagcaggaccatcagtttgtcattcatcagatgaagttcaacgactggctccgagccctcaactgaggaattgcatcaagaaatggctatttggaaggcttaatgaaagactaa

SEQ ID NO: 78 - DNA, 550 bp, Ctenocephalides felis
ggagaacggacaccaacagcaaggtggcgagtacaccaaggccatgaacaaggactggcactctggtcacttctgctgctggcaatgcgacgagtcactgaccggccaacgctacgtactccgcgacgaacatccttactgcatcaagtgctacgagagcgtcttttccaacacctgcgaggaatgcagcaagatcattggcattgattccaaggacttatcttacaaagaaaagcattggcatgaggcatgtttcttgtgcagtaaatgccgcgtatctctcgtcgataaacagttcggaagtaaattggacaaaatctactgtggaaactgctatgatgcccaattcgcttccaggtgtgatggttgcggcgaaatcttccgtgcgggtactaaaaaaatggagtacaaaactcgtcaatggcatgaaaagtgtttctgctgctgtgtgtgcaagactgtatcggaaccaaaagctttattctcgtgagcaggaaattattgccagctgtatgaggaaagttcgcaccagatcattaaatgcataaga

SEQ ID NO: 79 - DNA, 550 bp, Ctenocephalides felis
ttatttttgtgtgatttaataaattctagtgaactgttcattgctaaatatcacatagaaatgtctataaataacgataaaactaatttggatttgttggaagaagacgacgagtttgaggagtttccttgcgacgattgggcatcacacgacgaagatgcagatgatgttacagtttgggaagataattgggatgatgataatgttaaagatgacttcagccagcaattaaggtctcaaatgagcaatcctaaagaggcatctaaaaaaagttaagactatgtatatattagaatataatgtaatttcaaaaaacataattaataaactgattttttaaatnttaaaaaaaaaaaaaaaaaaaaaaaaaaaccctngggggggggcccggccccaattcnccctatngggagtcgnttcaattcactgnccgngttttcacgtcgngactgggaaaccctgcgttacccacttaatcccttgagcacatccccttttcccagtgggnaataggaaaaggccccccgntccccttccacattgcncacct

SEQ ID NO: 80 - DNA, 549 bp, Ctenocephalides felis
gctatcagtccacctaaaagcaaaaccagcccattaagtgtgtcttcaaaaggaagggccatagatttttcaaatcagtttgacgttggcgaaaagcagaaaacaaaaatagacgacatgaatgacatgatgtcgacaaaaaacatcatcgccgataaggataaaacgaaaatcgacagcaaaggtcttgatgatgtaagcatggatgatgacgatgacgacgatgtgatatcagcaggcgacgtttcgaaaagtaaatcagaacaatcactggctcgaaaaccaatactgaccacaaatgattcgccaaatatgcaagtgcattgtatcttcaatggaacaacatataagccaggacattcgttagataaacactgtgaaggcatgtgcaaatgttccgaagaaggtctttggagatgtgagcccaggtgtgaagctcttatgtcacaagactcctgatggcaccctaaatgatgtcaccaccaaaaatgaaaggggtgccgcgaaatggccacccaacaannatgctgcctgtctggttggcancgt

SEQ ID NO: 81 - DNA, 500 bp, Ctenocephalides felis
actgttgctcttcgcgaaatccgtcgttatcagaaatccactgaattgttgatccgaaaattgccattccaacgtttggtgagagaaattgcccaggatttcaagactgatctacgtttccagtcagctgctattggtgctctacaggaagccagtgaggcttatctcgttggcttatttgaagatacaaatttgtgcgccattcatgccaagagggtaacaattatgcctaaagatatccagttagcgcggcgaattcgtggtgaacgtgcttaaaattcgggttatcaagaagccagatatcccacatgcacatctcgatatttacctattataaatatacacatatatgtggaaatcgtgacatttatgtttaagcattcacttttataacaaatcatctttacatcttangacgtagtcaaaaatttggtaacaatattttgcatttgaatatgaaattttagctttaatcatatttatattatcatttttgtgta

SEQ ID NO: 82 - DNA, 238 bp, Ctenocephalides felis
aaacaattccgagattaacggggctcgacccggcgaaatcggtgcttgcgtatcgagcgcaataaaaacattatataacacaaacaatgcagattattcggttaacgaaattataagtgaaaaaaagtcattaggaaacacaaaaattaaacataaaatcaaacctagcattagcaaaaatgccgaaaaaaatattaaaaaaaatactgacattattccagaaatgttaaaatctggt

SEQ ID NO: 83 - DNA, 500 bp, Ctenocephalides felis
acagggnaaaacacaattatgccatacattagctgtaaattgccaggtaaacatatttcacaaagaattatcagtattataattaactgcattatctataacaaaaatatcttatattccataagaattttaaaatagatttcattacttttcaaataattagttattagttaaaatattttctagatttattttaaatatatttttgtgttaaattcaataacatcaaaatattaatgttttctcacaatctcgtaacagaataattattaattaaatattcttaaattaattctttgcagttacctatagatcaaaatggaggtgaaggcaaatgtttatatatagacactgagggaacatttcgacctgacaggttattggctgttgctgccgttacaaattatctggtagcgatgtgttagataatattgcatatgcacgagcatataatacagatcatcaaacacaacttttaatatatgctctgcaatgatgtc

SEQ ID NO: 84 - DNA, 500 bp, Ctenocephalides felis
actcgcggtatacgctcttggtgtcagatttttcttcgtgtttggcatggaccaatagtttattgtcgactgtcttgacaacaatttcttctggtgcatattgactaacatcaaacctcaatttcagaactttgccatcggcgtcctcacggatcaatggtgaattgaggtcgtccaaccacgtgctgacttgtctgcctggtgcgcccaagtttgagctggacagcctttggtcagtggaagtttgttgtgttgtgctgcttgtgcttttgaagaagttattactttctctattcataagctcggatctgaatttagacatttcctcttccattttcttcatttcggcatcaaatctttccctgatgctgctgaattctgtatcaattacactgaaatctccaagcttgattgggatatcgngtttaaatccactatcanncatttttataaaantttatttaanattcacatcacacanaattaattaattggtaaat

SEQ ID NO: 85 - DNA, 413 bp, Ctenocephalides felis
tgcagactgcttctaattctttttgnttgngttcgtattcttccttatcggccaattggttagcatccaaccatttaataacatcattgcatttgtccataattacagtcttatcggtttcggcaagtttatccttcaatttttcatcttccatggtggatttcatgttgaagcaagtaagattctaacgagttcttagcagcaattgtagacttttgtttctcatcttcatttctgtatttctcagcatcgttaaccatcctttcaatgtcttcttgctaagacgacctttgtcatttgtaatggtgattttattttccttgntggttgatttttcaattgctgtgacattaagaataccgttagcatcaatatcgaaagttacctcaatttgtgggacaccacgaggtgca

SEQ ID NO: 86 - DNA, 500 bp, Ctenocephalides felis
actgcaatcttcatcagatttcgttgcagtgtttgaaagatttttgaatgctgaatctgcaccagatagacctaacaaaatgtatatcatatataagtataagtttttgataaagatttgtgatactatataactaatttatttaatttaggaagaggaatttatgaaaatattgaaacaaaaaactattttttattcaagcataatatttaattattaattagatcgataattaacaaacaatcaaaatagttccaattcaaatagaactaacctcttatctgcagtgtctctgcacattttaaaagatcttgtagcccttcttgtgtaacatttacttcccccttatacatgaaatcaaccaacgcttgtaattcccaaaacctaacatctttcaaaattataattggatgctggcaaggattttctcccagtagactttcaaaaaatccagaacaagcggccaaaactaacctatgacaagttagtgacgccttcca

SEQ ID NO: 87 - DNA, 550 bp, Ctenocephalides felis
atttttctgacaacagactttaaaataacatttaaactgtccgattcaattatttgataaaaatgaagacaattatagttttcgcactaattaccattgcagcttgcaaagggcaatctacttgccctaactttaacgatacacaacatgacactggcagaatcgctcttatgaagaaatagttgatttgccacagaaaccagaagttttacttattgatgttcgtcaaccggaggaattggagcaggaaggaaaaattccgacggctataaacattccattacgtgaattggaaaatgctctcaagaacatgtctcctgaagaattcaaaaccaaattcggaagagataaaccaacattcgatactgaaatcatttttagttgccgttccggaaaacgagcaaaggaagctatggaaacagcattgggattgtntacaagaaatcaagatctacgaaggtagctttttagaatgggcacaagcagaagaacagtgaattgcaggtaatcaattttttatgtcacatttattacaattgaccaactagtt

SEQ ID NO: 88 - DNA, 549 bp, Ctenocephalides felis
gatagagtgttcgtctttggtttaggaagttacatataattattcaagatgcctgaagatacacaaaacgctggtgatgtcgagacattcgccttccaagctgaaattgctcagcttatgtctttaattattaatacattctactctaacaaagaaatcttcttgcgagaattgatctcaaattcatcagatgctttggataaaatccgctatgaatcccttactgatgcatctcgcttggacagcggcaaagatctccacatcaagatcattcctaataaaagtgagggcacgctcaccattattgacacaggcattggcatgacgaaagctgatcttgtgaacaatttgggtacaattgcgaagtctggaactaaagccttcatggaagccttacaagctggagccgatattagtatgattggtcaatttggtgtggttctactcggctattcgtgtgataaagtcacggcacatctaagcacaatgatgatgaacaatcctttggaatcttccgcagaggtccttacagtaagactgcacttgacc

SEQ ID NO: 89 - DNA, 549 bp, Ctenocephalides felis
agtcgttcgagtctggttctgtaacaggcggcaaaaagagaaacgcatgacgcccccgaacacgatgggcagcgacgtctccgaaagtctcgtgtacaacgcggcctacgaccagaacttgggccacagcctggtccacaagtacgaggacatgcccggcggaggcggaggcgcaaggcacttggatgacacgggacgacacctggaacacggcgtgtcgcacctgggccacgaaatggccaacaagttcgaagggcacgacatgggacagaacctgggacacaatttaggccacaatctagttcataaattcgaagacggcagcaggcacatagagcagaacctcgagcctagttattcggaagcgcagagtcctggcaattagcataggacgtgtaaatacgtgagttagggacataaattcaagtgactgattagtgactgaacgatgttataaatgacaacgtgagtgcgaaaacaaaacgtcttgacgaagaaatatcgttaaagtaaaaaaaaaacaaacaaatgaaataaccaggggtaaaa

SEQ ID NO: 90 - DNA, 549 bp, Ctenocephalides felis
acaagttcccgaccggtcgcttcgcaaaacggattctaattaaaatttagtgttttaaagcaagtgttacgtgttcttgtgagtgtttattgtgtgcaaaaatcgcgccgagatgtccgacaacaaaggagagaacgccacatcggaatcaccgaagggcaaaccgggcagacgaaacagagctttacaaagaatgaaagaagagggtgaagcactaattaagtctctaggtggaacccctgaaattgaaggcagaaggcgtactaggtcttcactaaaaacgccagcaacacccccagttacgcccccaactcccacgaaaaaggcaaaatctacaccagcacccaaaggcacaaagggacgcgggaggggaagaaaaagtgaaaaggtggaggaggccgaagaaaagcaagaatcaacagaacaagaagacgaagtagacgaatccaatgcacttactaaattcacctccgaagacaaggccaagtagaacaaaatgtaaaacagaagaccttcagaagaaccgcaaactgatgactgttaatccga

SEQ ID NO: 91 - DNA, 251 bp, Ctenocephalides felis
actcttcccacagtgagagaaaaagtttaagttctattcatcggtcgtctaaggaaaccactcatcagcagattgaaactcaatctaatgcacgaaataaacaccaagtatcatcatctaacgctacctacgttattgaacgcccgcagaaaaccgttcgacgcgataatctgttaactggcggtgaattttatggtcaaaaagattcaaggtatggtaatttttctaattgtgaacaaagtctaagaagt

SEQ ID NO: 92 - DNA, 375 bp, Ctenocephalides felis
actccctttgcgccatgaagatttcaggcgcatttcgagtatcaagtccgccttccatgtccagaaggtcctggtgttcgtcctgttcgtctgattcggatgagtcgtccagttcgtctccgtctaatgaggacggacaacggaacatatgctcaccgtcgcacatgcattgctgagccgcctggtagtcgcggctgaaggctgcggtgttctcgaagttctcggtgcaaccatgctcttctgttaatccaacaggacagggattaggtggattacaataagcgggcaaattatccgtttttacttgctgatgattcattgcacttncatctggtttgagcctttgttggccttcaccagcgcctncacttacgt

SEQ ID NO: 93 - DNA, 550 bp, Ctenocephalides felis
gcaaaagcaatgactgtatcaaatggcaatttagtagatgttagattttttggagcacatgataaagcatggatacctatgaaggattgcttgctttatagtgagaaagatccaaatttcagtgataaaggaaaacgctctgatttcatcgaatcacttagggagttagctatatatgtgaaaaatcttgagcaaaaatttggaaaattttgtcatgcaccattcaaaactccatatcctaatgatcaagcagctatttatagtataatgttaccttcatataaattcaaatcagatattgcaaataaaaaaataataacaaaacaaaaagtttgtgacataacggataaactactagaggacacaaaaggtaacatgaaaataaataattcgttagatgaggatagttatattgaaggatatgatactgaagatgaggaagcactaaaagatgtatcaaatgaatctgtgatatgtaatgatatgaaaattaaacaaacccttgcgtgccgtgttagaatgagagnggtaaataattcacaggaaaata

SEQ ID NO: 94 - DNA, 549 bp, Ctenocephalides felis
aacacaccaagagtacaacattcgtcgtgctggatatttgacattattgtatacaaatatagcggcacacgatcgtatttattcgcgaagttttgacacattcagcagatttttggatacatacagcaattcaggagttatccgctgaggaaatcaatttgagcgcaattagacgatcagatcgtatacgaatcaaaaatcaattaattggcagtgattttgtcaggccattttagttaacggcgcgcgtttgttatacttttaactttgaaagttttctccatcgatagttttcgttaatcaacgtgaggaaaagttctaatcaagatggcagtagcagcagcacaaaagaaccgcgaaatgttcgctatcaagaaatcctacagtatcgagaacgggtatccatccaggcgccggtcgctggtcgacgacgcgcgtttcgagaccctcgtagtcaaacagaccaaacagtctgtcttgaagaagccgccagagagcacgattcgagtctcgatggcaagaccatggacagatgtatatgatgacaag

SEQ ID NO: 95 - DNA, 240 bp, Ctenocephalides felis
acttgtaacaattgagatgttaaacgcaatgaacagtttgtctgaaaatcaatctcttcttgctatgcccccatggcaaaacatgtggttggtaggatccatggctctctccttcactcttcacttcgtcattttacatgtagaagttttatcagctgttttccaagtaactccattgtctcctgatgaatggatcactgtgatgaaattctctattcctgttatattgcttgatgaagt

SEQ ID NO: 96 - DNA, 431 bp, Ctenocephalides felis
acaataggaagacatagatttacgatcgcgagagaattcgagagtgaactcttttttccatttggtttcaatttcctggcggacggcgatggcagcagaacgacggtctagtccttgtttagaaacattgaatggattcattttttcagccaatacaatcaaggcggtttcggtagcttcaccgactttttcgaaagcttgtttgaattcgttgaaatcaatagcggaatcattgcacatgatacagattgttcctaattcatgcagggtgtcaaattcgctggccttaactttagcacctttcaagtatacatcaccaattggttcataagtggatccagtgatttcgaattcagtgaaactgctatcgctaccttcaattttgtcaaagacaaacatacgagatcagacatctgattagtggtcaaagt

SEQ ID NO: 97 - DNA, 500 bp, Ctenocephalides felis
actgcgagacactaacaaaactcaaaaaagccattcaaaatcgccggagaagaagaccgagcaagggcgtggcggcgaagttcttcgaagcgggttttcaaaagtgaaaaactctttagaaaaaatgcgatgaaagatctggcgactatgtagaaaaataatttgaaatacaagctttccgatggtatacacatttattgcaataaaaatgcctcaaccctgaaaaaaatgtgggaaccttactttttgcatgaccctcgtatgatttcaaaaaattgagaatgtctatcgatttgttacttagacgtgtcctttgtttacaatatttcccaaaatagaaaatactctcttacttgcgaccgaacttgattgttgttaaagcctgatatactaattctatatacactggtataaaacctaaattaatatatacattagacaaaggataacacaaaacttttctggaagccatagcagactgataagattccaaatgctga

SEQ ID NO: 98 - DNA, 350 bp, Ctenocephalides felis
acgcgtaataataaaaagagagaaaatatttaaaataaaaatatttaaatttaaaaaagaaaagaaaaacnttatcaaaattattaaaaccaattcattattgcatcatcttacaaaaagacccgaaaatacacgacgttaaaatatgaaataagaaaaaaaaactctactaatactaccaaccaattactctataactatttattatacaacaatccagctggtcagatatgaatagcatgcctatgtttcaactatttgaaaaaaagtaagtccttgttaaactaacaaatccgattcggcactgtctgcctggctcaaaaaacttcggctctctgcacgcgtttcgt

SEQ ID NO: 99 - DNA, 200 bp, Ctenocephalides felis
actgctgtagctaaatctgcttctgaaatggtgttagctgatgataacttctcttctattgtcgctgctgttgaagaaggtcgcgctatttataacaacatgaaacaattcatccgatacttgatttcttccaacgttggtgaggttgtttcaatcttcttgactgcggctcttggtcttcctgaagctttaatccctgt

SEQ ID NO: 100 - DNA, 273 bp, Ctenocephalides felis
catcttacatctaccgggacatcatagctacaaaaaatttcttnangataacaaacaattattagtgtgtaaggcagataaaggaaacatttcagtggttttgttaaaagaggaatatgataaagaagcaaagaaaattctcagtgatgaatctctatatgaagaattggcatcggatccgaacaactatcaccatagacaagtttttaaatttataaatttattagagaaaaagggacatattaataataccatatcattaaagttaaaagt

SEQ ID NO: 101 - DNA, 550 bp, Ctenocephalides felis
aagaatatgaacaaatagtagtagcaccagttcaccctggtttagatgtacaggaagcacaactaaatgaagataatgaggatttcgcatcaaggcgtcgataccatcaatcagctactgtgcatggacattacgtaaacattgacggatagttgttttaattaatgatcacctaatacatatttgaccagtattgcaaatttttgagtcacaaagctattgatttagatttttatatatccttataaaagctatttctatggtataatttatttaatttaacaaaaatttgcaatattagcttgtattttaaaaagctgattaaaatttattgtgaagtatctaatttattaaaaaaaatctaatataatgaataatatagaaatgaatgaaaaccgactcgagtgcagtcaacattactgataatgtgatttgatgcattttgctttattaaaggctaaattagttcaaaaaggccagtgtttaatttaatatttatcacttatttaattcaaataattaatcactccagttgtattataaataatgt

SEQ ID NO: 102 - DNA, 550 bp, Ctenocephalides felis
agcaaccgacgctggcgtcgtttgaacaagacggttttaaacgatttttatattcacctaaagatttctataaaccattctatgaatggttagtaaagcaaccacattccaaaattcaagtacagccgaacgaagtttgatttgttaattagtgtttttgtgcacattgattggattgaaaagaacgccgccaagagcgtaagaagcaatcatggaggacgcacatgcgaaatccgtggacgaagtcttaggatatttcagtacagatcctgaaaggggattgtctactgatcaaattaaaaggaatcaagctaaatatggacctaatgaacttccaacggaagagggtaaatccatctggcaattagtacttgaacaattcgatgatcttctagttaaaattttactgttagctgctattatatctttcgttctcgccctttttgaagagcacgaagattctttcactgcttcgttgaacctttcgtcattntactgatttgatcgctacgctatgncggtgttggcangaaagaacgctgaatcgcta

SEQ ID NO: 103 - DNA, 549 bp, Ctenocephalides felis
gcttctattcttaaggtttaaattcagatcaattctatatttaaatttcagaacaatcttgagcctttatcatgccttctgatgccaaaaaacgtgaacagcaacgcaagaaggagcaagcgaaagccagacaggctggcaaaaaagttgcaactaaaaatggtgaagaaaatgacaaagaacaatctccagcccccaaccaaactaatggagtgaaaagtaatggaactacagagctctctgcagaagaaattctttgtgcgaaactggaagcagaagcaaaattgaattctgatgccaggtcttgcacaggatctttagctgtccatccacgctcaagggatattaaaatagctaatttttctgtaactttctatggttgtgaattgcttcaagacactcttttagaattaaattgtgggaggagattggtcttttaggccttaatggaagcggcaaatcatcactattgctgtcttggtatcgtgaagtaccaattctgacatatagacatctttcattaactagagaaatgctgtaggntaattg

SEQ ID NO: 104 - DNA, 500 bp, Ctenocephalides felis
acacaaccaaactgttaattccctgcagcgcctgctgagggacgccagaggttctataactttcaaaatcgttccatcatacagaagtgcaccgcctccttgtgaggtaagcgccgcatctgatgcaatgcgtttattccggattaggcctacacctgnattagtatttgngcgtgcccagtttgactatgatcctttggaagatgatttaataccatgtgctcaagctggtatttccttcaaagttggggatatattgcagattatcaataaggatgactatcactggtggcaagcaagaaaggatgctgtcgaagggtctgctggattaataccttctcctgaacttcaagagtggcgaatagcaaatgcggctcttgaaaagaataagaacgaacaagttaattgctctatatttggaaaaaagaattaaaaatgccgagataaatatcttgcaaaacatatgctgttttgatggatggatcttgntacctatgagg

SEQ ID NO: 105 - DNA, 248 bp, Ctenocephalides felis
accaagtaacttttaccttcttgtcagaagttttcaaactgcacataaactctgccgatttaccttcttcgatagtaacatcaacaagtcctttaacaatttgtggtttttcgcctttttctggttcaggatccggtaaatctaagatcgttacttcttgtgatgttgcctcgcccttttcattctttacaaccaatttgtaagtacctgcccnctncncttcncnnancanngntgccatnantcan

SEQ ID NO: 106 - DNA, 494 bp, Ctenocephalides felis
accgtcgtcttgtaaatgctgtgaatgatattgagaagcgtattcctttctctcaccacgatagattaggtttcctcactttctgtcccactaacttgggaactactgtccgtgcctctgtgcacatcaaggtccctaagttggctgctaaccgcgccaagttggaagaagttgctggacgttacaatctccaagttcgtggaactcgtggtgaacacactgaagctgaaggtggtgtctacgatatctccaacaagaggcgcatgggcctgactgaataccaagctgtcaaggagatgcacgatggcattgctgaactcattaagatggagaaagaaatgtaaacatttcacttttatcatcagactattttttgtgatcaaataaatggtcatgcgatagatattggcaaagattctatcagtatttctattttaaataataatttatattatattgntacaactttttttaataatttaatttttatttgt

SEQ ID NO: 107 - DNA, 445 bp, Ctenocephalides felis
acgtaaacatccatacatttagggcagtaggactttaccatagcctctccaggcacatcagaaagacctaatggcagcataggctgactatcgcagtaaactctagggcaatatccgaagtctccagattggtatttttctatcatttgagctatacctctatttgttaaaatatatctggcgtgaattagaccatataacatctctgcagcctgttctattgcatctgactgatttggattatcatctatttcatcatcaggttctaaatctaatatcatatccaaggcttgtctatatcgtggaatttgctcattaaggcctgttagattgaatttatcctgtatatagtcttcatccacctcgcaaaagaattcatttcctcgtagatcacaaaaccaagatatccatgagacctcctcagaactgctcattttccttttgg

SEQ ID NO: 108 - DNA, 500 bp, Ctenocephalides felis
acaatcgggcacaaccaaagcataatacaacaaactttcatcgtaataattaaatgattatttctatcacttaccgaggcatttttcgcataaaacagagtgtgtcctttcagcctgaaatatcgccttctccatcgctgtaaggaccaggtctgcttcatgagaaatccctctctggttgcggcctgccggaaattaacagaaatccttgtaatacagaaatgtgacaagaatatttaaattggagttgacagtatcgtaatgaaatatcttgggcatgaaaagcattcgaagatagtctataatgggtttaattcaatcagtttcaaaaaataagaatcttgatatcgatataaaatgacaaaagctctactaagattttttcttcagtataaaaaaataatataaaattgttagaatactttacatatatcgcataattcttaacacaatataaaaatgaataatccaaggnaacgaacgtatttaatctcttacac

SEQ ID NO: 109 - DNA, 343 bp, Ctenocephalides felis
caaaantgcgtctgagggactgnntcttaatttattcataatatcaaaatagttattnatttgcaaattgntggtaattcactcgcgtttgtttatttataattatatctggntttcttctcgatttgctatttaacctntagcagccttttgcacttttgctgntggtaataatttcctatccgtaacaacacaatgggaaactgggaataatccgtccttaagcacacatacgcaatcactgtgcatttcagttctactaatttggtctaccaaactgtttgatactacactgatgaagttcttgttttgcttttgggctttagcgtgttggaagntctgt

SEQ ID NO: 110 - DNA, 491 bp, Ctenocephalides felis
actcctatcgtttgtaacatttacattcccctttactttattattttcatctcctgctacgatctgcgattcatttgaatcttcaatatttaaattcgctggagcattttcgatttcttcaagagccgtcaacgctcgcagttcttcttctatcaatttctttctagcagctattgcttcaaccgagcttatactttcccttttttcacactcgccgcttttccttgaacgaaaactgcgtctctttcgactacccgagcctcttttcacggttctggaaatcccatccaaatttcttaaaaattcctcctgaggcgttgcaccaggtgtagaccaggttgaccaggatttgacgtcctcctcttcgtctccggaatcttccacaacttccgccttttttagcttttctcggacactcctcgtgtaatcggacaagtccggacttgctcgaccgcaaatcgaaccaacacacagacaactcgcctttcaac

SEQ ID NO: 111 - DNA, 500 bp, Ctenocephalides felis
acggaacccatgggaatgtaaacaaaatttatacttattgttaaaatctctctaaaatatctgataatttgatgtgcatatgtctaatgatcatttttgaccgccaaatggcacatttttttactttttcctccatatctccaaagtcgttggacctttccaaaattttgaacagttcttcatttagtcaatacaaataaaatgttttttaaattattcaaatcggacgctccgttctcttaaaaactgagttaccgttttcggcactttttgccccgtatcttcggaacggctagacctacctttgccaaaaactaatcagcacgtcttcttatcaatatgaatcgaatgttttttaaattattcaaatcggttgattcgtgttcccgaaatcgtcgacgaaaatttgtatccgcacatacatacatacacacacatacacacacacacacacacacatccatncatttttctaaggatgccaaaatgtcagaaacctt

SEQ ID NO: 112 - DNA, 500 bp, Ctenocephalides felis
acggtaaacaatgtatccaagattcttatacatatttattgctacttcattactaactcgaacaaacaggtcaacaaaatatgtattttttctttctgatacatcttctaagaaattcattaatttagctgctaagccaagtctacgaaaatctggggaaacagttagggctgtgacatgtccatgccaattttctccatgaccttctgctttgcccattatatatcccattatttctccgtttggggactcagcaacttgaaaatactctggccaatgcgctagatattgcatgtagaatgaaagtccatatgtttctgttagtggatctaaatttacattattaaaattaaacatatcattgcaagtaaacggtcttaatgtagtcatattaattntattgcaaaagatatcagaaggaatttaattaacaaaagtcacgcctttaatgaagtaaaatattcagagaaaaaataaaacgagttactaatatttctact

SEQ ID NO: 113 - DNA, 256 bp, Ctenocephalides felis
cgatcattttcaaatctagataatcgcacacattggtgaaacttcacatcctcaagttccacagatnttgacttacccctgcctgtgctttcaaatagaactttatcatttaagcctaatcttaattctggcattcctgatagatatactctcattttgatagcaccgacaatttcacttcttagaacattgccatttacatttgccaaaagatttacggattctattacatctaaaaatacttcattttttcggt

SEQ ID NO: 114 - DNA, 550 bp, Ctenocephalides felis
ataaggataaaaagaaaaggaaaaaggagaagaaagagaagaaattgaaaaaattaaagaaaaaattgaagaaagaaaaactcaagaataagaaaacagaagattcagacaaaaagaataaagatacgaaaagtctcaaaaatgtggtatcctcatcctcttcatcatcttcggaaagctctgattcagatgatgagaaatcatgtatcggtccagtgcaaaaacaaagtgctggtcttagtcataaggactttggacatgcattgttacctggtgaaggagctgctatggctgcatttgttgctgagggaaaacgtatacctagacgtggtgaaattggtctcacgtctgatgaaatcgcgcagtatgaaagcgtcggttatgttatgagtggaagcaggcatcgtcgtatggaagctgtcgtatccgtaaagaaaatcaaatttattccgcggatgaaaaacgtgctcttgctatgttcagtaaagaagaaagacaaaacgtgagcataggatcttagncagttaaagagatattaattcaagtatcc

SEQ ID NO: 115 - DNA, 549 bp, Ctenocephalides felis
attnagagtagcagcttcaaagatcaggcgttncacagaaggtacttcgacgtcttggaagatccagaagccaaatcaggagtagtgcgagcgcgcaattcaccagtcattttgaccaaagtgggagtcttcaaagagtagacgaagggcataccagtttccaaggggaaggcaatggtgataacatcgcggttgtacaatttagtgaagtcgaaagattttccttgacggagagattcggcggcggagcggatggctttgggcaaagcgttcaaggtttggttgtcgaaagcaaagaatctcttggtgttcaacatgcgagtggaaatgacagcttccaatttttcagcttcttcaggtttcatgttcaacattttggcgattttttcaacagaccatttgtcttcagaagagtggtcgctttcgtgttcagattcgcggttcttgaattgagcagaaactacttcaaccaatctttcaacactggagaccatggcgtagacatcggagtatctttgtttgtatccggcgaagtcagcttcaagcttg

SEQ ID NO: 116 - DNA, 549 bp, Ctenocephalides felis
gcgaagagagttagatcactgtagaagacagatttcagaacagtccggtcaaatatctcgtttacaatctgagttaagtattagccaaaaaaatgaaggacaatatacaacaaaattagctacagctttggaaacagttgaaaaaaatatggcacggagcaataaaagggcaatagatgctgaaagtacagttgcaaagcttaagaaacagatttcacaaatgacgtcagagatgatggttcttcgaaatgaaaatacatcactgcgctatggtccagctgcaaatgattccaatagcatgatgagattatcaaatgagttgcgaactgcagctagtactgcagagtcgtcactgaggcaactattaacgggtgttgataatttaaggactcttgtagttctttagaaagctctaaccgaatatttgaaccttctgatgacaatttctgcgaaaatgaagatgaagatgccggcctgactataatgtgtagtgaataaatttntcattcaaatgtcttgtattaaaataaatattctagtttatatgct

SEQ ID NO: 117 - DNA, 549 bp, Ctenocephalides felis
gaaatatagagaagttactaagaaaactatggttaaacagtttgaatgtgttaaggatcacccgacgccaaaagctgtgttctttacttgtatggacagtagaatgatacctacaagatttacagaaactaatgttggtgatatgtttgttgttcgaaatgctggtaatttggtacctcattcccaacattttttggatgaatatataagtgctgaacctgctgctttagagttaggttgtgtagtaaatgacattcggcatataattgtttgcggtcacagcgattgtaaagcaatgaacctgctatataaacttcaggataatgctttcgcttctcaggataataggagaatatcaccactacgagcatggttatgttcgcatgcccaaagcagtctggataaatttcaacaacttgctcttagtgattataaaacacctcttatttttactgctgagactcctttaagaaaatttgtggttatatagatcctgaagatagttttctgtgaagacaaatatcacaggtaaatctctgcacaactcaa

SEQ ID NO: 118 - DNA, 549 bp, Ctenocephalides felis
cacaacgttgagttatccttgtaattgcaagtgcatttaaaaatataatttgtttggcatagaatttgtgaaaaaacaggagcataaatatgctttcaaacattcggattcaaataaaaattgcccgtgtacgagaattaaaagatctgcgttatttttcttcttctacaacaaatttcgctgaacacaaatgtcgggtattggtggtcggaggcggctctggaggatgcaccatggcatcaaaactttgttcacatttgcgacaagatgatgtcattgtattagagcctagtgatgtccattattatcagccaatgttcacaatgattggaggtggcatgaaaactttggaacaatctcgaaggccaatgtcttcagttttacccaagaaggctcgctggctaaaagattcggcgaaaacattcaaaccgatcgaaaattcagttttaacatcatctggtgacaagataacatacactatctcgtgtgctgtggttgaaacttnttacgcaagatcctggttgtaaaagctttgctcaccaaatggca

SEQ ID NO: 119 - DNA, 549 bp, Ctenocephalides felis
aatatgtgtttactatttaatgatactgtaagaaaaaacgatacgtacgtaattctgacattgactgtcattaataatgggatatgactttcgaggttattattgagaaatgaaaacgtagcatttacttatagtacgttatatggtttttgattggtttaaataaactaaataaaatgaagtgcaacaataacgatacgaatggccattcaaaaaggcatttggaagcgaagatctccgaagctgaagaggtaatagaaaaatctttatctcaatgtgaggcagatgaaatttttatgtctttcaatgggggcaaggattgcactgttttattacatatactccaaagagtttataaacttaaatatggttctgatgcacctccattactctgtttatatgtgagacctaatgatccttttcctgagatagaaagttttgtgctgagtgcaaaaatctgtccccataaatctaatacatttnctcttccttaaaactgctttaaaagatctgcagtgcgnacctcactcaaactagttcatggatncg

SEQ ID NO: 120 - DNA, 549 bp, Ctenocephalides felis
gactaccaaatggtgttcaagctcaatgtcgtgcctttgttgatacatatggagatgcctttattgccatatttgtgcaagaattagatccatcgcaggtgtgtcccaagttatctttatgtccaaataaagaagttgaagtgtttgaacaagaagataccagagacaaaccaacttgtcctatgtgtctaatggctatgtttgaattagaagagaagcttaaggaggataaaaccaaggcagctgttgagcaagcactatctggattatgcaatcatctttctgatcatctgaaacctgcttgcttaaccttagtaaatacttattataatcaattagttgaaatgctgatggctgattttaaaccacaagaaatttgcgtgtacctaagattatgccatgataagaatcccgacttaagtgaattggatattcttgtgcagtaccaattaataagacccatgattaatgcaaatgaaatattggacaccacaattaatggcaaaccatcaggtgtgtcaaacaacttattctgaaaattttgccaac

SEQ ID NO: 121 - DNA, 549 bp, Ctenocephalides felis
gcataatgataatccacatgtagaaaaacaaattgttgagttaatatatgatgccgtactatttgaaaacttgtcaaaaaattataaaaataccgcattgtggcaagaaatttttgttttgccattctactccctatataaggagaatttgataaacctaatagacattttacatatagatacaagatatgcaattgaaaataaattacaccaagcagccagggcaaaggcactgtattggactcatgcactttattattttgagaaggagttaaagtactcgtcaaattctccaacgtcactaagttttgatgtagaaaaattatataaaagggttctttgtaaagagaattcagatacaaccgatcttggctggatacatatcacacagatattcaaaaatttacccgcagaatgcatatctgtaaaatttgatggcaaaatgattcatggataagttccgctggaaccaactgtgccgccagatgtatgtcagagtccgaattacgcgatgattctgtactcnccgtcgagataatgatgtctctg

SEQ ID NO: 122 - DNA, 339 bp, Ctenocephalides felis
accatggctgatacttcaattccggcatcaggatggtattttccatctttcatcactccaagtttcttgnaaacgcaattgatcatgcattttcctgcttttgaatctggtatgttcttctgcaataatttttcgatatcatctgaagatgctcctgtttctacagcacaatctttgcctatctgcaaaagtttttcctttgcttcttctttggtatagctctgccgcagaatataaagcgaccagtgttccaatcaccaagaatatcttcattttgattttcttctacttcaaatttataaaacaatttgnttataattttcaaatgtagtatttact

SEQ ID NO: 123 - DNA, 500 bp, Ctenocephalides felis
cccgcacaccacacatacatcaattttttctgtgggtgccaaatattcagaaaactcaaaaacgtaaagatatataaaatttttcattttcgattttttgcgattactataacttgccccatgggaagttaataatattgtgtagttatttatgatcaatactaatattatgtgtagtaatccataatcaagactttttatcatttttaactttccgtggggcaagttatagttatcgcaaaataatcgaaaatgaaaatttgatatatctttacgtttcaaaattttctgaatattttggtataccttagaaaaaatggatgtatgtgtgtatatgtgtatgtgtatttttttatagaggtgcgaaaaaaaatctccataagcagacaacgctagacggtagtgtgaagatttttgcgacgccttcttcttactactggccctttctncggtttattcttcaaaggtgctgtgcatatgctgctaagctgccagtttct

SEQ ID NO: 124 - DNA, 489 bp, Ctenocephalides felis
acttaaactatgagctattctgtaactcattttttttatctttattttgtaaaccatcttgntcataaaatttgctaactacgcatttactttttttttgacctatatattttatctaaatactattcctaactctattctatctgggcgtgcattaattgtataaaagagaaaaaaaaaacagtctaaacaagtaatttctattatataataaatctcgcaaaagaataaagaaacaacagatgtaatacataataattatatcaaaaatagtcttactgttattataaaacatttgtaaagcgaatcgggcattgaatttaaaaaaaagaacaattattaaataatctcactatttaacctatgtgttatacggtaactcgccatttttttttctcgctttactttcactttgcaaactatctctttcctaaatcctagcgacttatgcattcttcgctttcgcttatttcatttattacatctagt

SEQ ID NO: 125 - DNA, 549 bp, Ctenocephalides felis
gattagtttgtagttaataattattaaaatgaacgactacttatcttctcctttaggatcagattctagtaatttagatgtgccagctcctattaaaactggaaagactgcatatcaactttctccgtatctaaattataatcctgtttacctgcctgcaagccaacccgaatttattttccctgaaggggctagtagacaaaggggtcgttttgaattagccttttcgcaaattggatcatcatgtatgataggagctgctttgggaggcatggctggtacatacaatggtctgaaggctacaacattgttgggtcaaactggaaagctgcgaagaacacaaatgttaaatcacattatgaaacaaggttcagctacggcaaatacactaggaacgatagcagttatgtattctggacttggtgtgctactgcatggcttcgaggagaagatgacgaaataaatactttaggtgctgcacagcncaggacacttataaatcacagctgacttaggaatgtncattggtggaggagtagatttctatac

SEQ ID NO: 126 - DNA, 549 bp, Ctenocephalides felis
ccggataaaagatatttattacaatggatgattcctcgccagatttccatttcaccacgatcgattattgtgtttttggcctggccctgttcgtttcggccctgacagggttgtactacggatgtaggaaatcaggggatgaatctgatgaaaacaatcagcagaacagcaataaaagaacagaagagtttctaaatggaaactccaattttaggcctctgccagtggctgcctctcttgtcgccagttatgtgtctggtgtcacgattttgggaacaccttcggagatatttcggtacggaacccaatattggataatagtgttgccaatcgctctgatgagcctagtggtggccaatgtttttcttccgatgttctgcaagttgcaagttcagagttcctatgagtatttagaaatgagatttaatccgtggtgaggacgatagcatccgtcatgtttgtcatagacgagctttgttctaccaattgtatatatgtgccagctttagcttttaatcaagtcaccggtgcgacgtcatggattgtacc

SEQ ID NO: 127 - DNA, 549 bp, Ctenocephalides felis
agattttaaggaacctttacaacctgcgaaaactgtcaatattcagatcgacgcggtattcagtaaagttttagtaccttatccatcaagcataattcaactagagcgtcaacttgtactctatcatggaaatcattacttttactctgcctatcgtactattaaacaacaaacaactgtacaacttgcttctaagaacatcgaaagcttctctaaactgaaaccattttcacaaagtgataccacaataacttatggctcatatgaaaacataccagcatttactcatgacaaaatgacgattcattatgagaatcatacaccgtttttaacagttacaaaattggaaagaacaattgaagtatcacattggggaaatattgcggttgaagaaacaattgacatggtgcattctggtgcattactgaaaggtcgtttccagatatgaattcaaaaagattcacgaacggttggaagtgtaaatcatataaaacttgcttccagcttctgattggggtactccggatctatggaatattctcatcaata

SEQ ID NO: 128 - DNA, 307 bp, Ctenocephalides felis
accattgtggatgaggcaaatcccatataccatgatgaagtttgcttgtttcgaaagaacagttgaattgttatacactcatgtggttcccaaacccagagcagagtgcactaaaggtgaacaattggttgtcacctttgctgctggttacattgccggtgtattctgtgcagtagtttctcatcctgcagacacagttgtttccaagctaaatcaagacaaaggagcaacagccattgacgctgccaaaaaacttggctttgctggtttatggaagggattaggacctaggatcatcatgattggt

SEQ ID NO: 129 - DNA, 440 bp, Ctenocephalides felis
nctcctggccaagaaacaagattggattgcattncatgcaaatgcgccagcgatggaacagggtacttttgcacccgccaagcatgtgctccagttcaccatcataaacgatcagctgaagaagtgaaagaagtaaccacaacttctttggcaacgactccatgcactcctggagagaagactcaaattgattgtaatacttgcacctgtgccagggatggctctggatacgcctgcactcgcaaaatgtgtttgccagccacccacgatcgtcgacgtagagaagctgaaactgaagaagtcaaagaagtcacaactgatactttggcaaccactccatgcaaagcaggagagcaaagacaagtggactgcaatacctgcacctgtgccgcggatggaactggatatcaatgcacccgncaagcttgtgagtttgcagt

SEQ ID NO: 130 - DNA, 500 bp, Ctenocephalides felis
acatatgatgctacatccattttgacagcatttcgctggaccccgacattgagcgtctgtatggcattctcgagaacatctatctttctcatgtccagcaacaaaactgactggacaagatcctggtttgttttctaatgaaataattattaaaatagatttattcttctacatttattctaaataaaaatatttttattttaataaagacatagcctatggaacgaaacttaccgagccgacattctccaatgaaaactgttctaccggaaacttcatctcgttgcaagtctattccgcatgaacttccttcgtgacagcggatatcagaacaaggatcaaagcatgagcattgaacacaattatttttatccacagatttatgaattccgtaaggacaacgtaattcttcacacgatcgatcgtcattgatgcaattgttaataatattctctaaatgaaaaaaacaaattagcaatcattaaatcttcttaaaaata

SEQ ID NO: 131 - DNA, 376 bp, Ctenocephalides felis
actaattgtggccccgccaatttcaaaaatgttgatttagtttgagctgcacatgcacgagccaataatgtttttcctgtcccgggtggcccataaagtaaaacgcctttgggtggatgtatccctaaatttatgaacttctctttgtgcgtcattggcaatacaaccgcttcaattagttcttggatttgcttgtctaagccaccaatgtcagagtattgttctgtaggccgctcatcaacctccattgctttgactcgagcatcatattcagcaggtaatgtttccaaaattaaatatgagtctttgttgacacctactaaatctccaggcttcaattgttctggatctactaaacctataacaggtagaaagt

SEQ ID NO: 132 - DNA, 500 bp, Ctenocephalides felis
acggaacccatgggaatgtaaacaaaatttatacttattgttaaaatctctctaaaatatctgataatttgatgtgcatatgtctaatgatcatttttgaccgccaaatggcacatttttttactttttcctccatatctccaaagtcgttggacctttccaaaattttgaacagttcttcatttagtcaatacaaataaaatgttttttaaattattcaaatcggacgctccgttctcttaaaaactgagttaccgttttcggcactttttgcccgtatcttcggaacggctagacctacctttgccaaaaactaatcagcacgtcttcttatcaatatgaatcgaatgttttttaaattattcaaatcggttgattcgtgttcccgaaatcgtcgacgaaaatttgtatccgcacatacatacatacacacacatacacacacacacacacacacatacatccattttttctaaggtatgccaaaatggtcagaacct

SEQ ID NO: 133 - DNA, 235 bp, Ctenocephalides felis
accaccccccaaaacaccattaatctcacggaacgtttctctagcggatttgcctttaacgaaggaaaactttaaaatagcgcgaatttcggcgtaagtgaactccatgtttacacgtctataactgttaaacgcaatatccaaactaatcatgcatagcatcgttttgtaggttatgtcaagacctttcaaattatgtatagtattgccagatacgagctctgtagcgctttgt

SEQ ID NO: 134 - DNA, 500 bp, Ctenocephalides felis
acatgtctatatttgctatattattaccctacacaaatccttttcgatataatcattacatagtatcactagctcatcatgttatagctgcttggtttttaaaatgcaggctgcctttcaggagagattttgtaaaatttatcaccacggtatgtgtgaaatataacaattgtgttaacttggtagtaaacaaaatatattaatcaattcatgacgtatagggcctaaaatcaaattgcattgcaccatttgaggaangaaggatattaattaaaccagaggttacaactttgaatgaagaatcatcttacngaaaaagaaagtctaggttaacagaaccagntaggtatttggaggttttcataagaaaaatgggtgaaatggtaaatgncaccccaagttttattggcngccaaaaaaaaatgntttgcanattancctaacntccaaattttgggtantgnataatttttaatttaccataatctangggttnaaaa

SEQ ID NO: 135 - DNA, 500 bp, Ctenocephalides felis
ctacgatatttctgncaagtcgaactacaattttgaaaaaccattcctgtggttggctcgcaagcttattggagatcccaacttagagttcgttgcaatgccagcattggtgcctccagaggtcaccatggacccagaatggaaacagaagatagagaaggatctgaaggaggctcaagaaaccgctttgccggaagatgatgaagacttataagttactttgttatagacaacatgaatgttttgtatattttgttaatgaaaatggtgggtttgaatttgaataatagagaatgggttctgcaaaatgtcgtgaaataattattttaacgccagatgtatttttttattcttaatcatctgnaaagtgaaaaatttaaaaatgtgagtgctgtaatcatgaatgctgagtgtaatataactttttaaagnaactcgcctaatttttaattataatttaatataatggtaaccagttgcatccaagtttcagtggtatg

SEQ ID NO: 136 - DNA, 550 bp, Ctenocephalides felis
atatagtggtctattaaagaataactgctgaataataaattaaacagaaccaatggctgcaattcgaaaaaagttagtgattgtcggagacggagcgtgcggtaaaacttgtttgctgattgtatttagcaaagatcaatttccagaagtatatgtcccaactgtttttgaaaactatgtggctgacatcgaagtcgatggaaaacaagttgaacttgccctttgggataccgccggacaagaagactacgatcgcttgcgacctctcagttatcctgatactgatgtcattctgatgtgtttttctgtcgactcacctgattcattagaaaatattccagaaaaatggactccagaggtgaaacacttttgtccaaatgtacctattattcttgttggaaataagaaagatttacgcaatgacccaaacacaatcaaagagttaagtaagatgaaacaggacctgtgaagccacaggaaggcgtgcctggccgagaagataaatgctttgatatttaaatgtctgttaatcaaaagaagagtccagagt

SEQ ID NO: 137 - DNA, 549 bp, Ctenocephalides felis
attaccaagtaccacctgaaggaaggatccttgtgggacataaacaattacctcgagctctcaccagcaccaaacggtgacagaatcgagcaaatcagtgcaaacgatcacccacaaagatcaattagattctatgttaggaaacttacaagcagacatgtccagacaaggtgttaatactgctcaaaaaggaagctgtggtgcttgtgacaaagccattgttggccaagttataactgctcttggcaaaacatggcatcctgaacatttcgtttgcaaccattgcaaccaagaattgggaacaagaaacttcttcgaaagagatggacacccatactgcgaacctgattaccataatttgttcagcccaagatgcgcgtattgcaatggagctattttggataaatgcgtaacagccttagaaaaaacttggcacacagagcacttcttctgcgcccaatgtggtcaacaatttggtgaaaaggttcacgaaaaagatggtaaccntattgcgcatgctatttcgattgttgtcccaatgtggagatg

SEQ ID NO: 138 - DNA, 549 bp, Ctenocephalides felis
gaacgcccaacgagtgcaagatttattttcgtattttatttcggtttattgtgcaaacatttcgatacttttgaagtattgagaactgtgaatagtgtttctgatttattatttatattcatcagcgcttgatccaagaaaagccttccaaaaatgagtgtcgctcgctatgaagatattgttgcaggccctttggccaaatttttgagcctttcaaaaagtattggcggagatgttgcgcagcaaactgtttttgtggagaatgcctttaaggcacaattagcttttatcacaactgctagcactgcatcacaacctgctcctgatgtcttacaacaattattgcaaccgaccagccaacagatattagcggctcaagaatttcgagaaaagcatcgttcatcgaacttcgtgaatcatttagcggcgattagcgagagcattgcgcactcggatgggtttgatttccctaccctgtgtgcatgtgaaagaaatgcatgatgctgacgttctcactgccggtcttgaagagaaaaggctactgccaat

SEQ ID NO: 139 - DNA, 549 bp, Ctenocephalides felis
gccagtgccgccatgtctgagagcttgaagcaactgccagtaatctgggttttaggtggacctggatcgggcaaaggaacccaatgtgacaaaattgttgctaaatatggattcacccacttgtctactggtgatttgctccgagctgaggttcaaagtgggtcagatagaggcaagaacctcacggctatcatggagagaggagaactagtacccatggacatagtacttgacttattaaaagaagctatgactaaggccttgcccacatctaaaggatttttaattgatggatatccccgtgaaaaagaccaaggtgtggctttcgaaaatcaagtgactcccgtaaacacaattttatatttcgaatgtaagcctgaaacattggtcgaacgtcttttgggacgtgcaaaaacttctggccgagctgatgacaatgaagagaccatcaaattgcgtttgatcttcatgccaataatgaccaagttttggcctatcccagacagactgaagagataacgcgaaaggcagtgataatctttgcggaga

SEQ ID NO: 140 - DNA, 500 bp, Ctenocephalides felis
gttttatatataaatataggattaattttaaggaatattattaaatttatttatattaatatattttactccncggccgcgannangctagcngtntccctgntcattggcggnngccccccnnnctctncnnncncccctcnctccccncctcncnncccccnncntctacntctctccccnccncnccnncctttntctcccccncccctcccnnnnnctcntctctcttccngncncncnncccntcncncctcnnccctcttccctccntcncccnnccnttcccnccctcncccctntncccncgccccnnccnnctcccntccctntnctnccnngtcnncnnnccnnctccnnncctccnncccccncntctcctcccctcncnnnnncncccctccccccttcnccnctccnntcgnnctcnnctctntncccntncccnnnncncnccnctntncctcngcctcccctttcntnnctcccncctcccnctc

SEQ ID NO: 141 - DNA, 500 bp, Ctenocephalides felis
acaagtttgattacaatgtaatttctaagcatttgataaaagtttatattgctagttttttaattataattacaaataacaacataaatatataacacatatgttttatatgttaacaacattaaactttataaataagtattaatatataagccattaatatttgctttagggtaaaaacttaatacaactccataaaatataaggccttgattattcacaattatctgatttaaggcattaaggtaattgttgaagtttatgaattataaaactttttactttataatcataatataagttaattgactgaataaataatttgtttgtataggtaactatgaccagccacccgttaacttatggaacatttcttgattcaactgttgatttgcatctttagatctcattgacataaatatgtaacctccgataaactcatggatcaccttgcaatctgctgataagcatgaaaatattatgntttcttcttcgaatga

SEQ ID NO: 142 - DNA, 285 bp, Ctenocephalides felis
acctgngtatttaattcttcttattataacatgtttnagtatcatatattnaatatacctgaattacggatatatnactataaacaatttctaaacataaaatcatatttacacaaatattttttatctattatttcaatttagcaaaaacttctcccaacatttgattacataaagcagcataaggattcatttccaccaactgattttttgcaaaggtggagcctaagcttgcggctttgttgaaatcttcccgagctaaatcgtcttcaccagtttttctgt

SEQ ID NO: 143 - DNA, 198 bp, Ctenocephalides felis
accacaggcattgacacaagggttaacacaactattgtcgatacaagcttggtcttgtctgcattcttcacttcctatgcattcgtatcgaaaacactgcctcaaaggatctcctttatgatttggcaggcatgaacaaacaggtaacccctcatggcttctagtgcattgcgcatttacaccacaggtgtgataggt

SEQ ID NO: 144 - DNA, 500 bp, Ctenocephalides felis
ataaaataattttaaaaaaaatatttttaaatttattagttatgtaatntaaaatgaaatantaataataataatagtagattagtattgtaaaagaaaaattaaaatngtgtataagtaaatttaatttattgtatctngtgtatcagagttaatttaataaaagatatgaagaatattnttctcgaatttaaaaggggaatttattatttaatttaatgnaatataattatttaaaataataaattagtaatgaaatgttattcgnttttaaagntatctagnttttttagaaataaatttaatttattatatttaaatatttatattaatttattaaatatagatattttaaatataaaatatttttagggataagcttaaaaataaattattataaattaataaattatttataaatttataggggtataaatattcattaatataaaaangtataatttatttataaataaattaaaattagtagattttaaatt

SEQ ID NO: 145 - DNA, 474 bp, Ctenocephalides felis
acaaaaacgcaggaaaccccacggntgcatttctataaaataatatcatagatttgaaaactatccgaatccaaaagttttaacgcctaatatttatatcaaaactttcccaacattatccctagattctcttaataaaactttcatttcattattagaaccactcgaactcaagtttaataaaaccatttcaacatttattaataatttcaaaaactttatatatcaccattatccccagcagaagtatcggagcagtcataaaattcttcatcagaatcttccggactttcggacttattttcaggatttgttgaagcagcattgtcccgttcttgctgccgagcaacgcagcaattcagcaattgtaattgttggtgaagaatacacgtgcgaggatcgggaaatccgcctccaactcccggtattttgtggtattatcaatcctgtatctcaattcttccacaaattcgt

SEQ ID NO: 146 - DNA, 500 bp, Ctenocephalides felis
ttaaaactaactcattcgngtaatgttaacatttaaaccattatacattgcaacaagatcctnggnggtnggctccaaagcattttcacaatacgcttcttattttattgatcctgttttcaaaccacaaaaacaaaatgaattagctcaagaaggtganatccaaaacttgcacacgtgcctattaaagctgctcgaaataatgatactagctctgtattccatgatgatctacttagcaaattcacaaattatgttatgaaaggcggacaaaaggttttggctagaaatttaatagatgaagcttttgtgaatattaaaagaatacaaattgaaaaatatcacaaggctaaagaggaaaataagagtaatattatactaaatccaaaagtgatattgcacaatgctattacaaattgcaggccaggtctaacacttacaccaatcaaaagaggaggtgntcgtatnagttcctatcccgacactgagaagcactcata

SEQ ID NO: 147 - DNA, 347 bp, Ctenocephalides felis
caattatgttatttcacctttaaaacttgtattatagcataatagacagaattatacttcatctattcatcgtttccgcaaataaaccaattcgaaaattacaatatattttgcataataaaattacataggaaaaataaaacatctattctaattaacttactccaatttttgaggctattttatcagcacatatttcagcaatatctcgacctagcacgccataatataacccataaaatagtaacaaaaaacctaagtccatccaagaatgcggcctttgattgaagattaaattgactccagcaaatgttgccatcaccattccataaccaattataccaagt

SEQ ID NO: 148 - DNA, 500 bp, Ctenocephalides felis
atttttaggctttaaataacccaatagattgtaaaagatgtaaaataaaaacactatctctgatgcttccacacaaatacctatttagtaaaataaaactaaatgaaatttattagtattttccaaactcatagctcaggcaatattataattaatttggtagaggcagtcttaataatagcatgcaaaaacaaaaataaatattttgtaaaaaaactattaaagtgaagaaactgatcaatacagttaaactataaaaaaaaggtaacaccttataactaacagccgaacaaaataagaaagaagcacttcattaaacacttacaggtatctggttaaatcctctatatcaaccagcatgctatcttggctcatatgaagttcatcacgattcattaataagcccaccaactgttcattaaatatttcaacctgtgtatggagtcggcaaacaacaacctgcaattgagcaatcgtcatgctggtcaacaaacgccggg

SEQ ID NO: 149 - DNA, 500 bp, Ctenocephalides felis
acttacaactgcctaaatggtccggtatgtcttntatgttcggtaaagggtatgaatcacccaggggcgtaacgtgccttggcggggccccatatcaaaatcggtttgggggctcccctaaagatttttcataatttaaagaaacataaagagattaataaattcatttaataaaattaaaagaagatttatttatcaaattttcaaatatacatcgaatattatttttaatattttacaagtaactaaaattaaatattcactctccttgcctttttatcagcaaactgatttattaagtcatttatagctgatgttgtttttagtttttctaatgtttttgcctctatggacaatagagacaggtctgatagacgttcctgttttattgatgttctgagataattttggattaattttaattttgaaaaactcgtttcagcagttgcggttgtaactggaagggcaagaataaaatgcaagctgttattacatccgga

SEQ ID NO: 150 - DNA, 550 bp, Ctenocephalides felis
gctaaaccacgtgtttattaatgtataaattattattaaacaagttttccggaaatatattgtagatcaaactaaacaggaataaaattgaataatacacaatgggaaaactgaacgtatcaatattacgttatttagacaaagaagactttcgcgttttgacggccattgagatgggcatgaaaaatcatgaactggtgccgggatctcttacagctctgatcgcaaatttgcgacatggtggtgttcacaaaattttaagagaactttgcaaacatcggttgctgagctacgaacgtggaaaacattatgatggatacaggctgacaaatatgggctatgattatctggccttgaaagcattaactatgagaaacgttgttgagtcatttggaaatcaaattggtgttggtaaggaatcgaatatttatgttgtagcagatgaagaaggtgaagccttatgtcttaaactcccagattggccgaacatgctttcgagtgtaagcaaatagagatatcatcacatagcatagagctctggnttattatc

SEQ ID NO: 151 - DNA, 549 bp, Ctenocephalides felis
ggaacgtgcaacatatttagttatttaaataatttgataatttaacaaaaatggcaaccattgttcgcaaaatcatcagcaccaaagctgcagccaagccagtggccccatataatcaggcaattttggtcgatcgcactctctacgtatcgggatgtctaggattggacgcctgcacaatgaaattggtcgcaggaggagctgccgccgaagcaagacaagctttgaccaaccttggacatatcttggccgctggtgactcatcatatgaccgtgttgtgaaaaccaccgtcttacttgccgatttagctgaccttgcagctgtaaatgaagtttatggacaagtgtttacacatgaccaccctgccagatcctccttcaagttggagcactaccaatgaatgctaaggtcgaaattgaagtcgttgcagtttcaggagacgtccgaactattccggagtggaatgctaagaaagtaagaataatatcataattaatagtgttcagtaaattatagtttatatgtaaataattaactaccatagtttt

SEQ ID NO: 152 - DNA, 549 bp, Ctenocephalides felis
acgaaagatttcgatggggcggagcgggcgagatggaggacagctacgaagcggctttacgacgaggactgccctatcccgtccttacggtcgctgaatacttctcgctgggacaagaaggattcgcttggggaggacaatatagagctgcgggatattatgcttcgattttacttggtacggcattggcgtgttggctgcttatgaacctgctcctggtagctgtcccgcgatatggagcctatttgatgtttacgactgggcttttattggctgccacggatttaggctactatctgatgttgccagcaaggcctctacgaattgtacttgaaggcggagcgctcgattttcgattaggatggtgcttctggctggtcttagttgctggaagtatatgctcattttccggattagtaataacgtgcgtggatttggcatttctcaccgattttcgactgtcttgaggtgactatgatctccntacgatcgnacgttatattgaagagacccgacacgcctcaggaaacgcacagtggcgnaacngcg

SEQ ID NO: 153 - DNA, 633 bp, Ctenocephalides felis
  CDS (67)..(507)
agtaaatactacatttgaaaattataaacaaattgttttataaatttgaagtagaagaaaatcaaaatgaagatattcttggtgattggaacactggtcgctttatattctgcggcagaggctgctaaatatactaaagaagaagcaaaagaaaaacttttgcagattggtaaggattgtgctgtagaaacaggagcttcttcagatgatattgaaaaattactgcaaaagaacataccagattcaaagcctggaaaatgcatgattaattgcgtttacaagaaacttggagtgatgaaagatggaaaataccatcctgatgccggaattgaagtatcagccatggtacacgaacacgattcagaattaatggaaaaagttaagaaaatcgcaaccgaatgtgacagcgaagccaaaggagaagacgagtgcgaaattgctgccaaagcaatggagtgcggcgtgaggatggccaaagaacacaacctaatggacgcgataccaatataatagttaaaaatttaatattaggtcggttgaagacctgtcaaaatgtagtcgttaaattgtagtgtgaagttgtcacgatgtgggcgtaggaataaaatgctatttaaaaaaaaaaaaaaaaaa

SEQ ID NO: 154 - protein, 147 aa, Ctenocephalides felis
MKIFLVIGTLVALYSAAEAAKYTKEEAKEKLLQIGKDCAVETGASSDDIEKLLQKNIPDSKPGKCMINCVYKKLGVMKDGKYHPDAGIEVSAMVHEHDSELMEKVKKIATECDSEAKGEDECEIAAKAMECGVRMAKEHNLMDAIPI

SEQ ID NO: 155 - DNA, 633 bp, Ctenocephalides felis
ttttttttttttttttttaaatagcattttattcctacgcccacatcgtgacaacttcacactacaatttaacgactacattttgacaggtcttcaaccgacctaatattaaatttttaactattatattggtatcgcgtccattaggttgtgttctttggccatcctcacgccgcactccattgctttggcagcaatttcgcactcgtcttctcctttggcttcgctgtcacattcggttgcgattttcttaactttttccattaattctgaatcgtgttcgtgtaccatggctgatacttcaattccggcatcaggatggtattttccatctttcatcactccaagtttcttgtaaacgcaattaatcatgcattttccaggctttgaatctggtatgttcttttgcagtaatttttcaatatcatctgaagaagctcctgtttctacagcacaatccttaccaatctgcaaaagtttttcttttgcttcttctttagtatatttagcagcctctgccgcagaatataaagcgaccagtgttccaatcaccaagaatatcttcattttgattttcttctacttcaaatttataaaacaatttgtttataattttcaaatgtagtatttact

SEQ ID NO: 156 - DNA, 441 bp, Ctenocephalides felis
  CDS (1)..(441)
atgaagatattcttggtgattggaacactggtcgctttatattctgcggcagaggctgctaaatatactaaagaagaagcaaaagaaaaacttttgcagattggtaaggattgtgctgtagaaacaggagcttcttcagatgatattgaaaaattactgcaaaagaacataccagattcaaagcctggaaaatgcatgattaattgcgtttacaagaaacttggagtgatgaaagatggaaaataccatcctgatgccggaattgaagtatcagccatggtacacgaacacgattcagaattaatggaaaaagttaagaaaatcgcaaccgaatgtgacagcgaagccaaaggagaagacgagtgcgaaattgctgccaaagcaatggagtgcggcgtgaggatggccaaagaacacaacctaatggacgcgataccaata

SEQ ID NO: 157 - protein, 147 aa, Ctenocephalides felis; identical to SEQ ID NO: 154

SEQ ID NO: 158 - DNA, 441 bp, Ctenocephalides felis
tattggtatcgcgtccattaggttgtgttctttggccatcctcacgccgcactccattgctttggcagcaatttcgcactcgtcttctcctttggcttcgctgtcacattcggttgcgattttcttaactttttccattaattctgaatcgtgttcgtgtaccatggctgatacttcaattccggcatcaggatggtattttccatctttcatcactccaagtttcttgtaaacgcaattaatcatgcattttccaggctttgaatctggtatgttcttttgcagtaatttttcaatatcatctgaagaagctcctgtttctacagcacaatccttaccaatctgcaaaagtttttcttttgcttcttctttagtatatttagcagcctctgccgcagaatataaagcgaccagtgttccaatcaccaagaatatcttcat

SEQ ID NO: 159 - DNA, 384 bp, Ctenocephalides felis
  CDS (1)..(384)
gctaaatatactaaagaagaagcaaaagaaaaacttttgcagattggtaaggattgtgctgtagaaacaggagcttcttcagatgatattgaaaaattactgcaaaagaacataccagattcaaagcctggaaaatgcatgattaattgcgtttacaagaaacttggagtgatgaaagatggaaaataccatcctgatgccggaattgaagtatcagccatggtacacgaacacgattcagaattaatggaaaaagttaagaaaatcgcaaccgaatgtgacagcgaagccaaaggagaagacgagtgcgaaattgctgccaaagcaatggagtgcggcgtgaggatggccaaagaacacaacctaatggacgcgataccaata

SEQ ID NO: 160 - protein, 128 aa, Ctenocephalides felis
AKYTKEEAKEKLLQIGKDCAVETGASSDDIEKLLQKNIPDSKPGKCMINCVYKKLGVMKDGKYHPDAGIEVSAMVHEHDSELMEKVKKIATECDSEAKGEDECEIAAKAMECGVRMAKEHNLMDAIPI

SEQ ID NO: 161 - DNA, 384 bp, Ctenocephalides felis
tattggtatcgcgtccattaggttgtgttctttggccatcctcacgccgcactccattgctttggcagcaatttcgcactcgtcttctcctttggcttcgctgtcacattcggttgcgattttcttaactttttccattaattctgaatcgtgttcgtgtaccatggctgatacttcaattccggcatcaggatggtattttccatctttcatcactccaagtttcttgtaaacgcaattaatcatgcattttccaggctttgaatctggtatgttcttttgcagtaatttttcaatatcatctgaagaagctcctgtttctacagcacaatccttaccaatctgcaaaagtttttcttttgcttcttctttagtatatttagc

SEQ ID NO: 162 - DNA, 631 bp, Ctenocephalides felis
  CDS (65)..(505)
gtaaatactatattggaaaattataaaaaagtttatttataaatttaaagtagaagaaatcaaaatgaagatattcttggtgattggagcactggttgctttatattctgtggcagaggctgcaaaatataccaaagaagaagcaaaggaaaaacttttgcagataggcaaagattgtgctgtagaaacaggagcatcttcagatgatatcgaaaaattattgcagaagaacataccagattcaaaagcaggaaaatgcatgatcaattgcgtttacaagaaacttggagtgatgaaagatggaaaataccatcctgatgccggaattgaagtatcagccatggtacacgaacacgattcagaattaatggaaaaagttaagaaaatcgcaaccgaatgtgacagcgaggccaaaggagaagacgagtgcgaaattgctgccaaagcaatggcgtgcggcgtgaggatggccaaagaacacaacttaatggacgcgataccaatataatagtaaaaaaatctttgttaggtcggttgaagacctgtcaaaatgtagtcgttaaattgtagtgtgaagttgtcacgatgtgggcgtaggaataaaatgttatttaaaaaaaaaaaaaaaaaa

SEQ ID NO: 163 - protein, 147 aa, Ctenocephalides felis
MKIFLVIGALVALYSVAEAAKYTKEEAKEKLLQIGKDCAVETGASSDDIEKLLQKNIPDSKAGKCMINCVYKKLGVMKDGKYHPDAGIEVSAMVHEHDSELMEKVKKIATECDSEAKGEDECEIAAKAMACGVRMAKEHNLMDAIPI

SEQ ID NO: 164 - DNA, 631 bp, Ctenocephalides felis
ttttttttttttttttttaaataacattttattcctacgcccacatcgtgacaacttcacactacaatttaacgactacattttgacaggtcttcaaccgacctaacaaagatttttttactattatattggtatcgcgtccattaagttgtgttctttggccatcctcacgccgcacgccattgctttggcagcaatttcgcactcgtcttctcctttggcctcgctgtcacattcggttgcgattttcttaactttttccattaattctgaatcgtgttcgtgtaccatggctgatacttcaattccggcatcaggatggtattttccatctttcatcactccaagtttcttgtaaacgcaattgatcatgcattttcctgcttttgaatctggtatgttcttctgcaataatttttcgatatcatctgaagatgctcctgtttctacagcacaatctttgcctatctgcaaaagtttttcctttgcttcttctttggtatattttgcagcctctgccacagaatataaagcaaccagtgctccaatcaccaagaatatcttcattttgatttcttctactttaaatttataaataaacttttttataattttccaatatagtatttac

SEQ ID NO: 165 - DNA, 441 bp, Ctenocephalides felis
  CDS (1)..(441)
atgaagatattcttggtgattggagcactggttgctttatattctgtggcagaggctgcaaaatataccaaagaagaagcaaaggaaaaacttttgcagataggcaaagattgtgctgtagaaacaggagcatcttcagatgatatcgaaaaattattgcagaagaacataccagattcaaaagcaggaaaatgcatgatcaattgcgtttacaagaaacttggagtgatgaaagatggaaaataccatcctgatgccggaattgaagtatcagccatggtacacgaacacgattcagaattaatggaaaaagttaagaaaatcgcaaccgaatgtgacagcgaggccaaaggagaagacgagtgcgaaattgctgccaaagcaatggcgtgcggcgtgaggatggccaaagaacacaacttaatggacgcgataccaata

SEQ ID NO: 166 - protein, 147 aa, Ctenocephalides felis; identical to SEQ ID NO: 163

SEQ ID NO: 167 - DNA, 441 bp, Ctenocephalides felis
tattggtatcgcgtccattaagttgtgttctttggccatcctcacgccgcacgccattgctttggcagcaatttcgcactcgtcttctcctttggcctcgctgtcacattcggttgcgattttcttaactttttccattaattctgaatcgtgttcgtgtaccatggctgatacttcaattccggcatcaggatggtattttccatctttcatcactccaagtttcttgtaaacgcaattgatcatgcattttcctgcttttgaatctggtatgttcttctgcaataatttttcgatatcatctgaagatgctcctgtttctacagcacaatctttgcctatctgcaaaagtttttcctttgcttcttctttggtatattttgcagcctctgccacagaatataaagcaaccagtgctccaatcaccaagaatatcttcat

SEQ ID NO: 168 - DNA, 384 bp, Ctenocephalides felis
  CDS (1)..(384)
gcaaaatataccaaagaagaagcaaaggaaaaacttttgcagataggcaaagattgtgctgtagaaacaggagcatcttcagatgatatcgaaaaattattgcagaagaacataccagattcaaaagcaggaaaatgcatgatcaattgcgtttacaagaaacttggagtgatgaaagatggaaaataccatcctgatgccggaattgaagtatcagccatggtacacgaacacgattcagaattaatggaaaaagttaagaaaatcgcaaccgaatgtgacagcgaggccaaaggagaagacgagtgcgaaattgctgccaaagcaatggcgtgcggcgtgaggatggccaaagaacacaacttaatggacgcgataccaata

SEQ ID NO: 169 - protein, 128 aa, Ctenocephalides felis
AKYTKEEAKEKLLQIGKDCAVETGASSDDIEKLLQKNIPDSKAGKCMINCVYKKLGVMKDGKYHPDAGIEVSAMVHEHDSELMEKVKKIATECDSEAKGEDECEIAAKAMACGVRMAKEHNLMDAIPI

SEQ ID NO: 170 - DNA, 384 bp, Ctenocephalides felis
tattggtatcgcgtccattaagttgtgttctttggccatcctcacgccgcacgccattgctttggcagcaatttcgcactcgtcttctcctttggcctcgctgtcacattcggttgcgattttcttaactttttccattaattctgaatcgtgttcgtgtaccatggctgatacttcaattccggcatcaggatggtattttccatctttcatcactccaagtttcttgtaaacgcaattgatcatgcattttcctgcttttgaatctggtatgttcttctgcaataatttttcgatatcatctgaagatgctcctgtttctacagcacaatctttgcctatctgcaaaagtttttcctttgcttcttctttggtatattttgc

SEQ ID NO: 171 - DNA, 133 bp, Ctenocephalides felis
ctgtangtgaagaattattaggcagagtagttgatgctttaggaaatgccattgatggcaaaggtgctttacaaagcaaaaccagattccgtgtaggaactaaagctcccggtatcattccacgtgtctctgt

SEQ ID NO: 172 - DNA, 498 bp, Ctenocephalides felis
gctgtaaattgggcggctcttgccgagcgtgttccacctgcccaaaaacccaatttaatggccttcaaagtaaaaagtgacggatatatgaggagggttgcggcgaatccggaaaatccaccagctttagattggaacttttataagaagtttgtgagtgtgcctggaatggtagccgaatttcaaaaacaatgcgagtctctgaaagtcccatatccagccgataattacacttctaaagtcgatgaacaagaacggcaagtcaaggctgaaatagaaaccttcaaaaaggagtctaatgatcgtattacaaaatatcaagctgatatggaaaggcttaaggctttgttgccatatgaaagcatgacgttggaagacttccatgatgcacatcctgacttggctttggatgctgttaacaaaccaacgttctggcctnacacttcagaggaacaattgggataccaatccaaagatccagtagaagctccttctcat

SEQ ID NO: 173 - DNA, 557 bp, Ctenocephalides felis
tccaaaaatattcttatggtagccaatgaggttggacgtaaaccaccaactttccaagatgcagctaaattaacaaatgctgtattgaattcaggttatgatttcgcatccggaaaaataatttacaataaatttaaatctgttgtctcctacagttctgctgaattaccattgtttagcctgggagctgttgagtctgccccaaaattgggtgtatacgattccttagatgctgatgtcatccaaagctacttggaattttcaatggcttcattattattctacacaatgaaggaaggagcttgctcggagcagtcatcccgtatgactgctatggacaatgctagcaagaatgcaggagaaatgattgacaaattgacattaacattcaacagaactagacaggctgtcatcaccagagaacttattgaaattatttctggagctgcttctttggattaaatttcatacnaatattttaatatgtggcttcatctaagtagctcaatttattacaatatctttaatactttggttatttttaatttgaatcttgg

SEQ ID NO: 174 - DNA, 498 bp, Ctenocephalides felis
aatcaattatttattgactatataaataatatacagatgttagttaaaattgcatacaacatgaacatttcattttcttctatttttgacaaagtttattttaaacaggtgttgaaataatttcagtgtacagctttactttactggcaacactcatatcaacataacgatctccaattgatacgaccattccacccaagattgagggattaactttaagggttagtaataagttttctttgggttttaagaatcctcttaaagtgctttcaagttgtttttgttgattctcatctaaaggtttagctgttgtaacttcacatggaacctctccacgatgagcagacatcataactttataagcgttgataacaccttccagtttatttaaacgtccattctcagcaagtaactccagcaagttggatgtagctggagccatttgcagcttgctgctggcttccttcaatgcatttgatttaatggagcgcttgaaag

SEQ ID NO: 175 - DNA, 236 bp, Ctenocephalides felis
ttttttttttttttttttttttttttttggnaaatttctctagangaaagaggnnttaaaacagcaaatacataagattgaataatagatacagcantttntaaaattaataaaattaattgagagaaaattaaaattcaaattaatcatatagatagggagtttcctgtattgccaagtaaagttagaattaaatgtccagcaattatntttgctgagagtcggatggctaaagt

SEQ ID NO: 176 - DNA, 161 bp, Ctenocephalides felis
atcttgtccttcctggtcacggaagtattcagntacagttaatccagtcaaagcgacacgggcacgggcgcctgggggttcgttcatctgtccgtagacaagagctaccttggaggtcttgtctttcaaggaaatgacaccaccttcaatcatttcattgt

SEQ ID NO: 177 - DNA, 549 bp, Ctenocephalides felis
gacangttatgttatttatttcatctgattttatcacataaaaacaaaaataagtagcatggatttcatacttttaattataaaatgcagtacagtttaaaatttgtcaaaaagacagtgttacttatttaataatacatgaaattatgcaacttacattttcattttggataacgtatttctaatccaatactcacttattttattaaattatgcattaaaagtagctaaaaagtcagctacaattttctttaattgggcatcagatgcttcactaatcgttccttccttggcaatggtttgcaaaagggatgaatggttggctttgatgtgagcgttaaattccttttcaaatgctgtgatcttggttgggtccattttgtccaagtgtcctcggacaccacagtagataattgcaacttgttcttcaatagccattgggacatattgccttgcttcaataattcagtcaaacgaacacctctgttaacaattgtgtgtggtgatcaagactgaccgaattggcaaaagcagcacctacgatttgac

SEQ ID NO: 178 - DNA, 400 bp, Ctenocephalides felis
gatncttgaaagtccgaaaattattaatatcattaattaaaatggaccagggaaaagcaccagttcgcgtttcacctctgatcaaattcggaaggtggagttttctcgttgtcggaatattatatggagcagctcaccaaagcaggctggcaaaacgcgaagtaggaattagagaagtcgaagctaaacataaagcaattcgggatgcaaaattagctgaggaaaagaaacgagctcaagaagaggaaaacaaatacttcgcttcactttaaacagattagcattattaaataggaaatgcagtaacattcaccataaggcattagatgtgctctgtaaattattcggattttatgtgaaataaaaagttattatacatacaaaaaaaaaaaaaaaaaaa

SEQ ID NO: 179 - DNA, 549 bp, Ctenocephalides felis
atcagccactgcttctgatgctgcccctcttcaatatcttgctccatactctggatgtgctatgggtgaattcttccgtgacaatggaaaacatgctttgatcatctatgatgatttatccaaacaagctgttgcttatcgtcaaatgtctctattgttacgtcgtccaccaggtcgtgaggcttatccaggtgatgtcttctaccttcactcacgtctacttgaacgtgccgctaaaatgtctgaagctcatggaggtggctctttgactgctttgccagttattgaaacacaagctggtgacgtatcagcttatattccaactaatgtcatttccattactgatggtcaaatcttcttggaaactgaattgttctacaagggtattcgaccagccatcaatgtaggtttatctgtatctcgtgtaggttctgctgcacaaaccaaagccatgaaacaggttgccggtccatgaaactggaatagctcatatcgtgaggtggctgttttgccaattcggctagatcttgatgcancaccaacaatggt

SEQ ID NO: 180 - DNA, 550 bp, Ctenocephalides felis
gttaatataggattcgttgtttctagaaccacaacaaattaaaacacaccaagatgttctcagcagcaaaattcatcgccccagtcgccaaatccgcatttgtcaatggatcaaaggcatatctgcgaccaatctcaagtgcagtattgactcaaagctctactatcaatgtattacctgcagccgctcaatctagcattttaccacaagttcgttgtctgcaaactacagcagtaacgaaagacattgattcagcagctaaatttattggtgctggagcagccaccgtaggagtagcaggatcaggagctggtattggttcagtctttggatcattaatcattggttatgcacgtaatccatcccttaaacaacaactattctcatatgccattcttggatttgcattgtcagaagctatgggacttttctgcttatgatggctttcttactgtattcgcattctaatttggttttcatttgcccgaagagggtctagaagagtgctnacgtatcaccaggactgtattaatcattcaaatccattant

SEQ ID NO: 181 - DNA, 498 bp, Ctenocephalides felis
caagttatctctgaattccttcacggctcctcttgcgcatttgccgacttcacgaaccaagttgcccaattgggaccaggtttctttgaaagccttggccaagtccttggctccttcacgggcagcttgaaggacatctttcaagcaagctctggcttcatcgacatcggctgcggtaacaacgcactccttggcttgtgctctgagggcttcggcgttctccctggcttctctccaggcggccaagccattttggcgaacttggttgaattcctcacgtttatcatccctgcaagccttgaccttagcacgagcttcttgtgcaaaacctagagctttttggtgttggcctttaaggcattcctttgcggcttcactcacttttttgctaagtttcctttcaacttctttgttgaacctttccaaatctctatcgacttcangggcaaatccttgtttttcgaattcagcagcaatcatttaattttgctatcntgg

SEQ ID NO: 182 - DNA, 498 bp, Ctenocephalides felis
ggaagcaccttaggctgtgcaggacatgtaactgtatagcattttgtgcccagagccataggtccgcaattatgacgtaacggatcatatgcaaaatttgcggggcaataatattgggttcctatactattttcgtcacaataataatagctttgacaatcatttatatttggataaaatctcgatggtgacggacatttgaaaccttgtactttgcanactgtactttctttagtggtgcactgtagatatccactttgatcagcgcacacttgatctgggctacaggattccttaaccggatctgctcctatttccggacaatactgcatttcgggtgaactgcacgaattcacgcaactaaattttacttttttacatttttgctcgggtttcggtacangtgtacgttcangagtagtactactcctggtgcgggctcatccaatgatgcaaatacttctttatttactgttaaangcgttccgtcgacattaa

SEQ ID NO: 183 - DNA, 424 bp, Ctenocephalides felis
ccagcatttgatggagtaaagaatgtatatgcttcttcaccccttcctaaagtgggtgttaatgtccttcaaggagaggtttctattataaaccctgataatgaactggaaaaaaaatataaagtaactattaaatttgcttcttatgttgacatgacttccctttcaaaatatatggaaaatggatcatctattgagacaccgcaggaagccctgcaatgtattgacatcatatttaggcatgcactctccaaacaatttgttcaggtgggaaagtccttctttacaccacccagtggtcgaattgtttctcttggtgatggaatggatctatggtatgggttattttctagttgtgttttangatggaaaaatgtagatgttgcacataaaaggatttcaactaaacaactantncagaant

SEQ ID NO: 184 - DNA, 313 bp, Ctenocephalides felis
aattcttggctataagttcgttgcatgttttgcaagtgatttgtttattgcatttattcccgtggcatattttacatgaatcagagtttgcattacaatcgttaccctgatctgatttgcatcctcgagtaatgacacctttttcaatttttgaatagcagtcgtcctttggattcatacaaactttggtcttcgtctttcctgcatctttgaaacattcgtttcttagttctggaagtttttgaacgttacaacccgatttctcgcaacacattttttctcggttagtcgagtcacaactttctttaaccgt

SEQ ID NO: 185 - DNA, 498 bp, Ctenocephalides felis
tatttgatctaaaagcagataaacactttctctgtttttgactgcttctttatcggcctcttgtcctaatcttagtaaacttgatgatgttagtgctaaaaattccttcatcctatcttcaatatcaccctgtccacaagtagtaaacaaagcaccaaaaatattattaatggctaaagccatacaatgcatattgttagtatggccttccaaacttgctcggtanaaagattgatcgcttcttgctaattttggaatagaaacagctacaaaaaccatcaataagcatactaacaaatgttcatcctcctcgtgttctgacttctgctgcctcaaagcatttgctanagttggatctactttacaagtcaaacctgctgccgatgacatctcaagaaacaattttcattgggtctccacttggcaatgatgtttaatgtccttggatanaacttataaaaatggtatacgctgttctaacacgtctactanagatct

SEQ ID NO: 186 - DNA, 498 bp, Ctenocephalides felis
aaaacttcaaagaacattccatccaatggattttcaaacattctcatcatacggtagtttgatataggaaaattaacaaatacaataacaatatattaaactattcatattagttatactatttatttcttaatccacaagttcagagacttcagtaattgtagcatctgctaacatgccttttttgtcaccagttattacatgaccaacaataaaagctttttgcttttcaagctcataaatctctttaatatatccttctgcatctgcttttggtaaagctattaataggcctcctgaagtttctggcaaatatccttctgctagcttaaacattttgctgaagattttggcaacttcggaacatttgtaaaaaactggtagtttattcaatacaaatgaaacattatttttctgattctgggccaaattatcagcatgaccgagaattccaaagcctgtgacatcagtagcatcatgagcattatatttatgcaa

SEQ ID NO: 187 - DNA, 498 bp, Ctenocephalides felis
cattcagcaaaggaccggtgccttctggcagtggtattgatccacgagcaatagttctaacattttctgcagaacagcaactaccagaaccgctacctccattggaaccacgaggagctaatatgtattctacttcttgacctaaatctaggtttgatgtgtcgccttcaaaattgctgaaatggaaaaacacttctttatcatgcgaaatggtctcgataaaaccgaaaccatccttcaaggctgctacaaatccttggcacaactggccgttgctcaaagactgacgtccatttttggagacaccattgcgcaatgaggtgcttgattgtgaagttgaactactgctgcttgacgagacagttgaaccgttaaagctgtggtttgatgactggttactaatggcagttactacaacatctgntgctatcagttctttattacgcttacctgactaatgttgaaatcaactttatcacccattctaggttgccgatc

SEQ ID NO: 188 - DNA, 549 bp, Ctenocephalides felis
gcacactggtgctgttgtaacattggaagttgcaaaacagggagctatttatcatggtctggctacattacttcaacaaccgagtccacttttgaatcaaggcccaagaagaatgtcggaacgcgatttgccgtcacgtgttagtgcagagggctcggttaaatctattctgccatctagtaaatcagtaccagcactgcaccatggtggttcttcgatgcaggaaatgtcagtgcaatcagctaatttaaaatctcatagcacccataacttaacacaaaatacaacaccacagcaagatcaaggtttttatcaaaacctaagtgtatatagaggaaattcatcacagccaaatttagatcgtggatcaggtttaaggtccccacagaatatggttcaacaaaatgtgcatcagagttctaggccagcttcagcatactttcctaaccaatctaggtgccaatcaaacttcaaccaacctgttctaatcttagatctcaaagcactaaagatattgaaacttttgcgtgaaatcttgnccaacagtta

SEQ ID NO: 189 - DNA, 549 bp, Ctenocephalides felis
gacaaccctatcagtccagcgcagagtttatataaatagggatgaaaataggcaagttgcctccgtgatgcaccattctgatctgaataatttgttgagagttggcagtttgatattcttaaatgtcggtcaattgctgccgcatcagctgcagtcgttccacacgccgaattacatctatccgattgggtatcagattgtcagattttactggtcgatgaggaggccgaataaacggtgcagatatatttgttcaatagctgatgttgctggacgtccagaatttcgagtacgcgttcaagaacctcaacaggatgatattgaactaagagatgctacaccaagggctgtttggaatcgaattctggagccattggccgctatgagaagggaattgggcgattcagttcgtctgtttcccaagtacgtcactggtgaagatttgtttggacttactgagccagctgttgttcgagtactcgaagtttaccaggaattgagacattaaccgatatcgcttcaagtatggaaggaccccttattgagctc

SEQ ID NO: 190 - DNA, 550 bp, Ctenocephalides felis
gctgtacgcagttatggntattgacacattaccatccattaggctctttgtacgancacctgaacagaacaaccttgactcataaccaaatggcacatatttgtctttcaattgcagntggattggttcacttacattcagaaatttttggaacagagggcgaaggtaaaccagctatggctcatcgtgatatcaaatcaaagaatattcttgtgagagtaaatggaacatgtgttatagctgattttggtttagcagttacacatacacaatctacaggagctctagatgttgcatctaatccaagagttggaactagacggtatatggctcctgaggttcttgatgaaagcatcaacatgcaatgcttcgaagccttcaggcgcgccgatatctacgctctgggtcttgtctatgggaggtcgctaacagaactctttcgaatggcattgtgaagaattaggccaccttactacgacgtcgtgccttctgatccaagcttgaggatatgcgcaaagtgtctgcgtgccacacagaccagtacacctac

SEQ ID NO: 191 - DNA, 492 bp, Ctenocephalides felis
gcatgtggtaacatgtttcaactgctgcaaggacattcagcagaaacttctggaggtcttttgatctgcctcccaagagaacaggctgcagcttattgcaaagacattgagaaacaagaaggttaccaagcttggatcattggaattgttgaaaaaggaaatcgcacagcaagaataattgacaaacctagagttattgaagttccagcaaaagattagaatgataatgatatgattatttaattacagaatgaaataaagggtgtatgtctgtgtcaacattatgctagttaaacaatggcatctcattcctgctatttgcaatgcttcaatatttttttgaaacaaattgttctattaatgcaaatgtagattttaagaatatatatagataagaattattgttttaagagtaattttgaatcatgaagaaatttcttgatttttcaattcttaataaagtcaaaagtaaaaaaaaaaaaaaaaaaaaaa

SEQ ID NO: 192 - DNA, 479 bp, Ctenocephalides felis
ttttttttttttgggaagttcaatttattttatgaatatagtatttagaacttcatacgatgtggatattgggaagatttcaaaccaaacatagctgacaaatatgtatacaaaagtttgtggtctgggtgcttcttgattactcctaaaaccattttgtctacaagcttttggtcattcttcctttgctcagttggtttataagcctctttcttggcagcaaaaatatcaccttcctctttctttgcacgcttgttcttttgccttttgaaataatcatcattgatgtgttctggtaatttaactccactaacgtctaatcgggtagaggtggcaatgacatagttttgggaaatgcgacgcaatgggcatgcattgattaagaanggacctgtaacaagtaacaatccagagtccaactgtttaagaagaactacacgttttccnttatgttgtccagctaaaacaatgcaaatcgt

SEQ ID NO: 193 - DNA, 528 bp, Ctenocephalides felis
agtttctggttacattccccaacgttattcctccagaaatggttgcagctttagagagatgtcttccacctcgaccagtagttgagattcctcctggtgctgaagaatgtatgcttattgacatggacccagaacaagaggcacgaagacgtagtcataaaaatgcatatgatgaagatgatgagggaggacctggagcaaacagagttcaatgtgccacgagttaaatcgtagtaacttagggcattgttttaaagtattgtctaacactatttatataattttcctacgatgataacatgagttttatgtcatctatcatatttatcatattgatacttggttagggttttacattgcacaattatttgtgactttgnaattacacacgatnttatgctccacngtaacggatgggacacccaantggnctaanggtaccattttttcntttttagatagacaatctttattttttgtatgtttcatagctgagaaatgcctggcctatgtgatatttgttccagt

SEQ ID NO: 194 - DNA, 370 bp, Ctenocephalides felis
ttctgataacaaaaggccctgtggataaagtctccatccctgttccgttacaatgtgtacatttgacaggctttgtgccaggctcacacctggaacctctgcatttctgacaagtatctactatgttgacattaatatctttattaactcctcgtgcagcttgagagaatgttagtttcatagatacttcttttgcaccaccaaatccaaaactggattcagcaaagtcatcaaaacctccagttttaaatcctgcatcaccaaatattttgtgaaatagttcttcagggtcgattgtcgattgatacttccaactctgtgagaagccttgagggcctgctccccccatgccgcccatctgttcagaggt

SEQ ID NO: 195 - DNA, 343 bp, Ctenocephalides felis
aggtggcggcgtcatcgtattacaaggactggtctggttcatttctaatccgtttgcaagctgttgaagtttagctaaactgaaactagtattagctccagtttgctctacaggattgccttggggagtaggagtcgctgtcggggtcggtgtctgcggtgcagacggtcctggtgtatgtgaatgtggatgcgtgcctgattgaatataaaaatttgtagcagtggaaactgcacatgaaggcgatgatccatgcctttgatgtggactcggcagaggatgctgagctgtgggaatactaccttgatttgacatcctatgttgtatcacagaactcatcggt

SEQ ID NO: 196 - DNA, 749 bp, Ctenocephalides felis
ttttttttttttttttttttttttttttagactatagttctatttattctttagcattttttgatgttacatttttacaataataccaagtaaaataatgacttcattcatataataaagggtttaatacgccgatttaaaaacagacatcttatacaaaattaaaatggctgctgntaaattatagaatatcttttgatttaaacaaaatctaaatagtacataaaactggacattacttccattatatatatagatatatacatatgtatgttaatgtatatatacataaatacatatagaatcaaacaatatcacaaactgttgatttgaataagttgctattcataaaattatgttttcgcatttagtacattttttgtatgtgcttaagatgtatataaacacatatttgntaattagtaaaaattaacataagcttgagacattattaggtgctactaaaattgataaatatttacataaattaaaacaatttcaattcttatatgtgtggnagtaacttcaaaatctgnggaaatattggttaaattggtactggnctgnaaataatttactaaacagaaattatattgactcctatctggcattggcttcttaaccattttaaatttaatttacttaatctcttcagaaatagcttaataaggngagacatcccagganaattggtggataaatattggtaaaagctcaacaggaacattgngacctgaatggctggcaaa

SEQ ID NO: 197 - DNA, 210 bp, Ctenocephalides felis
ggaagcaccttaggctgtgcaggacatgtaactgtatagcattttgtgcccagagccataggtccgcaattatgacgtaacggatcatatgcaaaatttgcggggcaataatattgggttcctatactattttcgtcacaataataatagctttgacaatcatttatatttggataaaatctcgatggtgacggacatttgaaaccttgt

SEQ ID NO: 198 - DNA, 185 bp, Ctenocephalides felis
accacgaggtgcaggcggaattccagttaaatcaaaggttcctaaacgattgttatctttggtcataaccctttctccttcatagacttgaattgttactgcaggctgattgtctgcataagtgctgaaggtttgtgttcttttacatggaattcttgcattgcgttcaataatcttagccattg

SEQ ID NO: 199 - DNA, 223 bp, Ctenocephalides felis
cacggccgaggggttcagagttgtcagtcttaactgtgaaggaacctcctgcggaagattcccaaaggtattgttcatcatcattgtgcttagatgtgaccgtgactttatcagcaacgagataggccgagtagaaaccaacaccaaattgaccaatcatactaatatcggctccagcttgtaaggcttccatgaaggctttagttccagacttcgcaattgt

SEQ ID NO: 200 - DNA, 465 bp, Ctenocephalides felis
cgaaagataaggactccgattgttctgagagcgggctttggggcaatgtggaggcgcaggccgccttcctggggcctaatatatgggataagacattaccctatgatgctgatctcaagtatgtggatctagatgagttcctttctgagaatggaatccctgtggatggaatgggtcacagcggtggattggggtccatgagtcacttaggtggcttaggaggatctcataggtctgaggctttaggtcaccctttgagtggtatgccaacacatctaacaaagattgaaagatcaccttcaccttccgaatgcatgagcccggatactatgaatcctgcttctccagctgattcaacattctcaatggcttcttctgggcgagattttgatcctcgaacacgggctttttcggatgaagaactaaagcctcaacctatgatcaagaaaagtagaaagcagtttg

SEQ ID NO: 201 - DNA, 312 bp, Ctenocephalides felis
attcttggctataagttcgttgcatgttttgcaagtgatttgtttattgcatttattcccgtggcatattttacatgaatcagagtttgcattacaatcgttaccctgatctgatttgcatcctcgagtaatgacacctttttcaatttttgaatagcagtcgtcctttggattcatacaaactttggtcttcgtctttcctgcatctttgaaacattcgtttcttagttctggaagtttttgaacgttacaacccgatttctcgcaacacattttttctcggttagtcgagtcacaactttctttaaccgt

SEQ ID NO: 202 - DNA, 209 bp, Ctenocephalides felis
attcagggctcttgctcttttctcatctcttgtcaaatgttcttcaggactgtctccattcttccgttgcttgtctttcttgtccctcgtttgaggtcttggagtagcacctgccatgtggggtgacatgtggtaggtgtgattatgggctataggatcgtaagctgccctaatgctctgctgacgagcaaagtccattgtgcaggagt

SEQ ID NO: 203 - DNA, 293 bp, Ctenocephalides felis
ccggagnctggggtggaagtggagcttttgaaggatgggtattggtttctgcccaaaattacaagagcaagatttgaagaattatgctctgatttattccgctctactttacgcccagttgaacaagcgttaagagatgcaaagttagacaaaggagccatacatgatgttgtattggtgggaggttccacaagaatacctaaaattcgatctctgctacaagaattctttgcaggaaagaccttaaattcttccataaatccagatgaagctgtggcttatggtgctgcagt

SEQ ID NO: 204 - DNA, 377 bp, Ctenocephalides felis
aaaaaggatataagaaccgatnttaggnntatgagacgattacgaactgctgnagagcgtgcaaaaagaactctaccaactagtacggaagcatgtgtggaagttgaagctttgaaggatggtattgatttctgcaccaaaattacaagagcaagatttgaagaattatgctctgatttattccgctctactttacgcccagttgaacaagcgttaagagatgcaaagttagacaaaggagccatacatgatgttgtattggtgggaggttccacaagaatacctaaaattcgatctctgctacaagaattctttgcaggaaagaccttaaattcttccataaatccagatgaagctgtggcttatggtgctgcagt

SEQ ID NO: 205 - DNA, 452 bp, Ctenocephalides felis
tttcttttaaattcgtccatgagatgatctactagacgattgtcaaaatcttcaccgcctagatgagtatcaccggcagttgctctgacttcaaatagagatccttcatcaattgttaaaacagatacatcaaatgtgcctccaccgaggtcaaatattaacacattcctttctccttgtaggtgtttatctaagccatatgccaaagcagcagctgttggttcgtttataacccttaaaacattcaaacctgcaatgacaccagcatcttttgtagcttgccgttgagagtcattgaaataagcaggaacagtaataactgcatctttcactttctctccaagatagttttcagctgtttctttcatcttaactagcaccattgcactaatttcttctggtgaaaagcgtttcagttggttcttgtattcaacttcaattttaggtgttgt

SEQ ID NO: 206 - DNA, 500 bp, Ctenocephalides felis
tnnttttttttttttttttttttttttttctgacgttgacacatccattgcttcaccacttcctgacgcatcaccagaacttaacttacgtttttttgtaggttcttcagacccgttagtagcagattgagaagcctcttgttcatcccccggttctttcttaatactgnaatctacgtatccagtaagccattcctttggtgtgttttcatttggctctccgtgtttgtctagtttgcctgcggctatcaaagacttcttttgtgatgccttaggtcctaagccccattttctgggatatgtatntcgctccattatcacacgttttaatttagcacagactccatggtcgcatgacatcattgttgctgnggtcattagagcgattgctaatgcaatagcttctcccttagtagtaacaataacaatttcctgattcatctcgattccatcttcatacctcaagacgccggnaacataactttngaccgnnacaaaca

SEQ ID NO: 207 - DNA, 264 bp, Ctenocephalides felis
acgtggtagaaattctagaagttgccaatttcttctgtcgactagttcgaatggtgtgttggttacccattcgtgatcatactggttcagaagataacaaccgacagtcatgcctcccaaaaagatcaatccaatggctccgatggagaaaaatcttcctttacatttgcagctggtttcagtatacaaatattgaccttctatatcttctgatttttttaaaagtggttgttcttggttgccttctgatggtggttgtgttgt

SEQ ID NO: 208 - DNA, 498 bp, Ctenocephalides felis
atttccttgtgctaattcaattgttcggggatgaagtgccagctctggaaccccttgaacaacttcagaaaccaaatcagcaactctagcctgacttgtctgtgaaccagnttgtccaggtgtgttagcagaactttgaatgataagattttggttggcagcaagactctgtccacacatatttctccgtttatgagatgctaaatcattactttgggcaaaagctctaccacaaaccatacaagcgtagggcttttcacctgtatgtgtcctcatatgtatagctaacttatcagatcgtgcaaatcctctgttacaaacactgcatacaaatggnttttctcctgnatgttttctcatatgcaatgnaagatctgtagttcttggataacctttaccacagattttgcaaaaatttgtcatttgaccagtatgtctccgcatatggacggntaaattacttcttgactgnaacttttaccacaaacactgnataat

SEQ ID NO: 209 - DNA, 470 bp, Ctenocephalides felis
aatcagattacagcttatttcacaaaaaatgagaaatnaagaatccacaactaaatacaatatgngtaaacaagataaaaatataactataaacaaaatataaatcaagttaatcttgaacataattaaataaactttttgtcaaaaactacagtaaaaataataaaaacatttcatataaatgtaaacaaaattgatgatcattgataattcttgttaaatgtgcttttttaaagcaaatttatttacatattaaacatctgtgaattttgataatttatctcgtagcatcatgttttctttcttcattcgctcaagctcttggcgaagaccaatattctccttctccaagtatcctgcacgtaaggctatttgattttctttcatgcgtcgagcatctcgagatcgcttggctgccatgttattctttctcctctagcccaatcttatcatccttcaaattatcaggt

SEQ ID NO: 210 - DNA, 500 bp, Ctenocephalides felis
ttnnnnnntttttttttnnnntnnttttggacctgaaaactatttattatcacatttattnaattacataatgattacnacttaacaactattcttaaattctagtcagatatcagncatataataaatacttaagcttttataagaaaaaatgcatcactagataattttttcagcccttattcgattaattttaatggctttgtttaatcaacttcttctatcgttggcccttgccttccaccaaagcctccggcttgctgcccacaagtttgtgcttgtgctccacttgaattggcttgatgtagcttcatcataagcggcgtacaaatctgttggaactctttctctttttgttcatattcatggcattctgcttggggattctgatctatccaaganaatatatcatcacatgccttgcgngctggttcacaatcttgctgnggaagcctgcttccacatcggccagagcttggtttacttgnaagcatatcctc

SEQ ID NO: 211 - DNA, 263 bp, Ctenocephalides felis
ttcatttcaggcataaattctgttgttttgtgaccattaataacatcaacccctggtaacatatgaccaggcccagtgtagtgccctggttcatattcaaatttcacaggtgtgctcacatgtggagctaaaggaggagccagagatctgagatgatttccattagaggatggtggactgttttgttcttggaagtatcttctggcaaacatatggtgtttcttctgagcaacaggaggctggcgcgaggatatcgaggcggt

SEQ ID NO: 212 - DNA, 244 bp, Ctenocephalides felis
atggtgcggtgaaagcaaattaccattaaaatatgtatttcccacacaaaatgggaaaaaggaattttgctcggagacctgcattgcagaattcaggaaggcttatagcaagggagcctgcctacaatgtgataatgtaatccgaggaaactcatctaccagtcgagagttttgttctaccttttgtatgaacaaatatcaaaaaaagaatgataagaatctcataaatttacccgttacgagt

SEQ ID NO: 213 - DNA, 418 bp, Ctenocephalides felis
atcatcagcaaaaccagcagtttaataatcagttaaatcaacaaaatcaacaagtaaatcatcagcaaaaccaacaatttaataatcagctgaatcagcaattgaataatcaacaaaatcagcaatataataatcagaatcaacaattaaataatcagcaaaaccagcaaataaatagtaatcagataaatcaacaacaaaataatcagcatgttaacacacaacaacaaaatatatctcaaggaagtaagcaagtaggccagggcaatcaaattccacaggtgcagcaacagcaggtgccgaccatgtagcttctgtgaatcttaacaataatattccacataaatctggggaaattcaaaacagtgtgtagacagtatacaactcctgagactctctattccaagcaagaccccgt

SEQ ID NO: 214 - DNA, 498 bp, Ctenocephalides felis
aacgtaaagacaaaggtaaatctcgtttcacagcttatatgctctgggctaaaggaattagaaataaaatcgtaaaagaaaatccttcaattgatttttcatctatatcaaaaaaattaggtgaactttgggcaaatgtgcctaatggagagaagtataattggcgtcgaagggctaaacgtatggctatgaaagtagcgagagatgaagaaataaaaacatctgataataaagcacaatttataaataaaagcaaatctaataagccctcccaattctccacttcaccaacagtttctaagaaacttgatatagaagatttagaagtgatgcctaattcccaacaaaattctgataatttaatgttgagccccaaatcatcagcaatgagcagcggtttatcatctcaaggcatgtataaggtaacaggaagttccccaattgacatagctgcttatctaaagttacttggcgagaggttgagtattattggnggac

SEQ ID NO: 215 - DNA, 398 bp, Ctenocephalides felis
gccattgcagccactactgaagttgaattcaaagaagctaccacaattaaggaatacattaaggatcccagcaagtttgctgctgctactgctgccgctccagctgctgctgctgcagcacctgctgaatccaagaaagaagaaaagaaagaggaatctgagtctgaagatgatgacatgggtttcggtctctttgattaagaacttgttccacaatattaacattttgggaaatccatatttatatgaatatttacatattcaagtctgtttgtgattattatctgtaaatacttgtctgaactttgcgcagttctgtggcaatttacaagattttatttgtaagcataactttgtataataaaatatggatgaggataaaaaaaaaaaaaaaaaaa

SEQ ID NO: 216 - DNA, 549 bp, Ctenocephalides felis
gagccatcttatcaaacatatttaatataaatttataataaatcgtgcaaagttttcatgttttaattaaaataccgattgaggtaatacgaagtacaatggtggataataaattagcaggattaacagaggaaaagctacgtgttttagtaaaacaatgtaacaaatgcccgaaatgtaatgaaatttgtctagaggattttcccgttgttcaatgtagtttgaaccacagactttgcaagacgtgctttttggcttccataaatgatccttgcttccagtgcactaagggcagcaaaccatccgctaataaaaaagatcggccaaagcagccaaatgccccagacaattctttcccgaaggtaaactgcaaatatgccagtgacggatgcaaaatctcaaaaaagaaggacaaaattagatttcacgaatcggaatgtgtgtttcaaccacaagaatgtctggaaaattcactgtttatttaattgtactggccggtatttcaacgcatgctacctttgtgagaacatcattaaatggaacacatga

SEQ ID NO: 217 - DNA, 549 bp, Ctenocephalides felis
caaacgtacataagaatgggagcgattattttaagttcagattaaattgtatatacttttgattcgatgtacgggcgcaatcatcacactcggagattgcagagagcttcaactgctgcacttctcgaaaacaccaacgaaaggttgccggtggcgagcgactgcagcacaggccctagcgtgcgttcgtccagctcgaacccgttgcaagccagcgcgagcactagtgctactatgatggcttccagccgagtgcccagtccgcctctgcaggaggtcaacacacccgtagctgagaactggtgttacacacaggttaaggtagttaaattcagttatatgtggaccattaataactttagtttttgccgggaagaaatgggcgaagtgttaaagtcttcaacattctcagcgggcgcgaacgacaaattaaagtggtgtctacgtgtaaatccaaaagggctagatgaagaaagtaaagactcctctactgattactacttgatctgtacaaatctgaagtcggccaattaattctcgatttaatgc

SEQ ID NO: 218 - DNA, 547 bp, Ctenocephalides felis
tttaacgatacacaacatgacactggcagaatcgctacttatgaagaaatagttgatttgccgcagaaaccagaagttttacttattgatgttcgtcaaccggaggaattggagcaggaaggaaaaattccgacggctataaacattccattacgtgaattggaaaatgctctcaagaacatgtctcctgaagaattcaaaaccaaattcggaagagataaaccaacattcgatactgaaatcatttttagttgccgttccggaaaacgagcaaaggaagctatggaaacagcattgggattgtgttacaagaaatcaagatactacgaaggtagctttttagaatggagcagcaagcagaagaaacagtgaaattgcagggttaatcaaatattttatatgatacacatattatttacagatatgatcaaactaagtattcttgnggngntatattagcatattgatattttcttacgaaatgttcttaagatgatttaaaaatattgtgaataaattgttacttttagattnncctaataaaata

SEQ ID NO: 219 - DNA, 549 bp, Ctenocephalides felis
gtgatgtcatttgtgcaaaagaaacaaactgaatgggaaccggagtggtctggagatgagagtataatggcattaatgaatggtggagaattatttatttatgaaatagataaatgtgagtttggaacatcatgggatggaaagccaaccaaaaaaattgggggaggtcgaaatggaagaataagcatatcaccatctaatactacaaccactttagctttttatgtacctggtgcgcaagctcagccatcgacttgcaaattatttgcatatcctaatatcagtcaaccagtagcttcaaaaagctttttccaggctgacagggttgattttttgtggaataatcgtggaacaaatctacttcttctaacagcaactgatgttgaccaaactggtgcttcatattatggaaaacaatctttgcagtatatgagttgcaagggtgatactgnttggtcagtgccaaagaagggctgtcatgcagttgcatggagtcctaagattagagtttgngtggtacggcattgcctgtaaactcantatcaatct

SEQ ID NO: 220 - DNA, 549 bp, Ctenocephalides felis
gctntttagacgttggaatctaaataattaaataatgataccgaaaatattattatttagtaactaatttacgaaaaaagtattttttaaattaagtaacatgtcagcatcagcaagcagatcggaatttgcaatcacagaatctaaccaacaagaagatgaatgtggaccacaattaatttctaagatagagggtaatggtattacaagtggggatattaagaagttacaagaagctggatactatactgtagaatcaatagcattcgcaccaaaaaagagtcttataactataaaaggaatatccgaagctaaagctgataaactattagccgaagctgctaagcttgtgcctatggggtttacaacagcaacagaatttcatcaaaaacgatcagaaataatattgttaacaacaggttcaaaggagctagataaactattgggcggaggtttgaaactggatcaataacggaagtttttggtgaatttcgtcagggaaaacacattatgcctacattagctgnaattgcagtacctatagatcaa

SEQ ID NO: 221 - DNA, 549 bp, Ctenocephalides felis
cttgaatagattatttactttgtccttaaatttcaaagaagtccctacgcgcaccaagatgggtagggaggacaaagccacctggaagtcaaactactttactaagctcgtccaattgttggatgaatacccaaaatgttttattgtgggagccgacaatgtgggttccaagcaaatgcaacaaattcgtatgtctttgcgtggaagcgccgttgtccttatgggcaaaaacaccatgatgcgaaaagctatcaaaggtcatgttgagaacaaccaggctcttgaaaagcttcttcctcacattcgcggaaatgtaggatttgtatttactcgcggagatcttgttgatattcgtgataaattgttggaaaacaaagtgcgtgctccagctcgtgctggtgccattgctccattgccgttattattccagctcaaaatactggtctaggacccgaaaagacatctttcttccaagctctgncatccaacaaaatttcaaaaggactattgaatcatcaatgatgtcatatcttaaaacctggggataaa

SEQ ID NO: 222 - DNA, 550 bp, Ctenocephalides felis
gcgaggcgganattgtnagtncttttaagtattaacaatttaattaagtttttatttaatttcgttatttttttttaagtttttacgtgaaagactttgaggagtgattgnttatcagcaaccaacanaaaatggggtccgagatgaaaagtacatgctacaaatgcaatcgcgtangacactttgccagagaatgcacccaaggaggcggaggtatgggaggtggccgggaccgcgatggcggtcacagggactcgggccgcgtgcgtgagaaatgctacaagtgtaatagatttggccactttgccagagactgcaaggaggaggctgaccgatgctacagatgcaatggcactggacacattgctcgcgcttgtctgcaaagcccagatgaccatctgttacaactgtaacaagccaggacacattgcgaggaattgtctgagagccgtggtntgactccagntaggtcaaccaacgtgttcaactgcacaaaactggtcatatttccgtactgccagaaatgctagacttgtatgctgtggaaagc

SEQ ID NO: 223 - DNA, 549 bp, Ctenocephalides felis
caagttttgtctgcaatatataaaaatttaagatggctaaagcaccagcagttggtatagatttgggtactacgtactcctgcgtgggtgttttccaacacggaaaagtagaaattattgcaaatgaccaaggaaacaggactactccttcatatgtcgcgtttaccgatacagagcgtctcatcggagacgccgccaagaatcaagtggccatgaaccccaataacacaatttttgatgccaaacgtcttattgggcgtaaattcgaggaccaaacagtccaagctgatatgaaacattggcccttcgaggttgtcagcgatggaggtaaaccaaaaattagagtatcgtacaaaggagaatccaaaaccttcttccctgaagaagtcagttccatggtgttgactaaaatgaaggaaaccgctgaagcttacttaggcaaaactgtgaccaatgctgtcgtctgacctgctacttcaatgactcacaacgtcaagccccaaggattcgggactatctccgtctgatggtgagatataacggcccccg

SEQ ID NO: 224 - DNA, 550 bp, Ctenocephalides felis
atacgataggcatttgtgcgagataattgattattgtgtgaaatttatgtgaataaatctgtgaaccgctctgtaggttacgatttgtgttcaatgttaaaagaaatgtgcaaacagtgaattcagatctgtacaagtgacatttgcatttaacaaatatggggaagacatactgtcaatcttgtcgcaaaaaatgttcaggtgaagttttacgagtctccgacaaatactttcatactcaatgcttccagtgcgtgcagtgcaataaaagtctcgcccaagggggcttctttcacaaagacgataaatattattgtacaggagactatcaaaaattatttggtacaaaatgcgcagtgtgccagcaatatgttgaaggcgaagttgtatcagctctaggaaatacttaccatcaaaaatgtttcacatgtctagttgtcgtcaagctgtgccgccggagaaaaagtaacatacaccggaaaagaagtcctctgccagaaatggttcaaatccagcagacaagtcaacagtcacagaaagtccntagtca

SEQ ID NO: 225 - DNA, 549 bp, Ctenocephalides felis
ttttcgtgcttgtgttattttgctacatgnngctgtctgtctggttgcacgaccatacctacagtaagggctattcggagttgacaaaaaactcagatgtcgaattcattgtagaagaacattattcggaatccgattccgatgcatcggtgcactgcgaaagagataataaaatcggttcgtcgcaaagacaggaacaacatgtgataataatccaaaaatctgctgatgacatacaccgatgcgaactgtgcaataagacgtttaaatttgcaacaaatcttaaggctcatatggttatgcacagcggcgaacggccctatgtctgtgccatatgcagtaaagcttttccacgaattgccaccttgaaccgacacatgcaagtgcatactgaatttaaaccatttcagtgtgaattttgtgagaagagatttcgacaagatgtnactttgaagaaccatatcangactcataccggtgagagattaattggcatggtgtgaaaatcttttaccgcctaccactctgaacacattacgatcacatgag

SEQ ID NO: 226 - DNA, 498 bp, Ctenocephalides felis
tgaaagagatgcaggcattgtggttgattcctccggaagaataaaaagtgtaatttcaggagaagaagtggaaaggatagctaacgaaactaaagttgaggtgttggactacggtcaattttcaatatggccaggtgtgatagactctcatgtgcacgtcaacgaaccaggaagagaatcctgggaaggatacaccacagctactaaagcagcagcttggggcggaattaccacaatagtagacatgcctttgaattccatcccacctacaactactgtagagaatttgagaacaaaagtgaattcagcctgtggtaaaacgcatgttgatgtcgctttctggggaggcgtgattcctggcaatgcgcacgaattgttgccacttatcaacgccggagtaagaggattcaaatgttttacaagtgaaagtggtgtcgatgagtttccacaggttactaaaaatgatctggaaatggctctaaaagagctccagaaagc

SEQ ID NO: 227 - DNA, 498 bp, Ctenocephalides felis
cagccgttatagcggttgaaactgataatatccaaatgttgtccaactttatcttcatcgactgccctcgacaatgctattgttactggccgtgaaacatctaaacttttcacgtgatcaacgatagccgaaaaataatcatccgatgccgtaatctgagttctaggttcatttgcaatggaccacattatcactcctgggcgattcttatcacggcgaattagctcgcttaacgacatcttgtgcttagcaagcaattttgaattgtaattctctgtatctacacttggacattcattgattatcatgatgccgtttttgtccgccaggtccataacttcttccgaataaggataatgtgatgttctatatgagttggccccaatccattttattaagttgtaatcttttgcaataatagccaaatcgagaccttttcacgtatgtcagagtcttcatgtctaccaaaacctcttagatataatttcctgtgattaa

SEQ ID NO: 228 - DNA, 498 bp, Ctenocephalides felis
atgtccttgaagtcctcgagccgatgcaagggtcccatccagaccgcatattcctccggcaatctcggaacaaaaagcgtgcttcgacctgttccgacctcaacggccccgaacagatcgggttccttagcgccaaacatgtattggaagtaggattcctgtttaaaaatgtagcccacatccgtgtcgttccagctgacctcttcacctccttgcagaaggataatggatttttttaaggaacaactttgtgccgataaagcatcgcacaccttcttcctgttctcggcgaataaactcatcggaactttcagcgtttttggtcccatggagaagacccgctgctgacccgatccgttggagcacttgcatgttgattctgccattattcttttaaactataacactaagcgatttacacaatttaattaacaataattactaaaaaaattaaattaaacacatataaccaaaaattttctgtcactgaacataagt

SEQ ID NO: 229 - DNA, 498 bp, Ctenocephalides felis
aacagttgcatgaactttgcccttcaacgtcattcctaagtatggtgtttctttattcttgtgttggattatgtctttagtgaccttaaattcttcctcgggatcccaaattactaaatcagcatccaagccttctttgatttgtccttttatgccatccagtccagttaatcgagcggccgcccgggcaggtacttgagttccccatccaatcaatgttactgcatcacctttcttgataatatcagcttttcccaaaggaactgtgaaatcatcgacaggaacttcttctacagctgctctgtaaagcgtttttggttccagtagcaaacatggatctttttctctgatcatggataatagaagacctttggccatatttggacctcttggtatagcaatcttcaatcctggagtatgtgcaaaatatgcctcanggctttgggaatgataacaagccccgtgtccgactgcatacaangtgctcgcactgttaaa

SEQ ID NO: 230 - DNA, 237 bp, Ctenocephalides felis
ctgctgctgcaccgggaacaccccctgatactggcgtatcacaaaattgagaattatgttggttcaccaattgtttaacttctttggcaactgctggatcgattgtgctggaatctaagaacaatgtatcttttttggcagatgccaccattcctttgtaacagtctaatactatggcgttgtttggcaacattgtgaccacaaagtcggattttttggcaacttcggcagccgagg

SEQ ID NO: 231 - DNA, 171 bp, Ctenocephalides felis
tgcttggagaaagtgcagttggaaaaagttctttggtgttaagatttgtcaaggggcagtttcatgaatatcaagagtctactataggtgctgcgtttttaactcaaactgtgtgtctggatgacacaacggttaaatttgaaatttgggatacggctggacaagaaaggt

SEQ ID NO: 232 - DNA, 315 bp, Ctenocephalides felis
tgatagagtgcatggccaatatgaatatccaaaaatattataggcctctcattacgatcatcatattgcccaaaagtgggtccgtggtctcgtcgatgaaaaaattatggtccacaaaatgatcaaaatctttcacgcccatttgtctgaccagctctggatctcgtatcagcaatacaggttttaaaacttcatagaaacctgaaaatctgctatcaggaaaattctcataagctcttccgtaggtataaatctgattttccaactggaaaaagtttctccaggtgcttccaaggatcggcacaggtttcaggt

SEQ ID NO: 233 - DNA, 247 bp, Ctenocephalides felis
agaactacttgcatcttttttaggatgtcttttgccacacattctgcggaacatcacttgagcaataaatattcataattttgcgaattccttgattttaaacaagcgcagacataatgtatgtatatatgtatatatatatatatatatattgaatggtagagtcttggatttgtgtatattttgtagagtttcgaacaagaatccaaaaataatacaaaaaaaaaaaaaaaaaaaaaaaaaaaaa

SEQ ID NO: 234 - DNA, 330 bp, Ctenocephalides felis
tggtgaagaatttgccggtcgcctagccaaagaaggaatacgatataaattaaagggaatggtagcagacccagaagaatgtgatatggaagaattggttagcatgaagtctataccaaattcacttgcggtgttctgcttagctacgtatggtgaaggagatccaacagataacgccatggagttcttcgaatggatccaaaacggtgacgccgatctcacgggtcttaattatgccgtttttggacttggaaataaaacctacgaacattacaatgaagttgcaatttatgttgataaacgattggaagagttgggagcaactagagt

SEQ ID NO: 235 - DNA, 417 bp, Ctenocephalides felis
aattaaatgcaattatatcaattctggcataaatccaaggcactattttgactattttctaattgcaaaatatcaagtgtttaataatgcaaaattttcttaacagcatcaaagcaacgccatttgtcgggtagataaaacggttcaaagacatgagggaatggtgtatcgtggccggtcactctttgaataggagcctcgagatgcaaaaagcattcctcctgaatggaagcagccagttcagccccaaagcctccagtgtatggagcttcatgtgcaataatgcaacgaccagtcttctttactgaattacaaacagtatcataatcccatggtagtatcgaaacaagatcgataacttcacaattagcatcaagtttttcttttacaatctcagctacttctcgtaaaacatgt

SEQ ID NO: 236 - DNA, 112 bp, Ctenocephalides felis
ctggtttgcaagtcattccactcggacatgtttccaatgttgtttctaagaaatcagngccaatcgcaatgcaaaggtttgctgtctcacaatcctggcactttatttctcc

SEQ ID NO: 237 - DNA, 325 bp, Ctenocephalides felis
actgtagtctcgtgaaatttgtttattaaaatccgaaagtaatggataattcaaaccacctaagccgcctacttttctatccatgttaatccatgctaagtggctaaaatgtgaatccgttgagcatccaacaacctcagcaccgatttcccgaaactggcctattgcatcactataagcacgaatctccgttggacagacaaaagtaaaatctaaggggtagaagaacaataccaaatatttgcctttataatctgttaagctgatcttcttaaaatcaccattgacaactgccataccttcaaaatgaggggctggactttgt

SEQ ID NO: 238 - DNA, 500 bp, Ctenocephalides felis
tgaagccctntgtgccggatgcgaggactgtgcaacggcttaggtcctgccatgtttggtgttatattttatctttttcatgttgatttgaatgaagatcatcttggaaataagatagaaagaaatgaaactgctggtgcagatgattatatacaattagttcctgggcctccatttgtttttggagcattgcttgtaatatgtgcacttttagtagcagttttcataccagaagagcacaaagatataagccgacgttcttctggtgtttctttagatacacattttgaaattgaacgtggcagaaaagttgcaagtcctctaccaccattgattcataccgattctgcacagctataaacatcatataccatcaccacctatgcaatacaattttattaataatgaataattaatttaaaactagtttgaaacccaatggttaatgataatgaaataaccagatacaaattacagatattttaaatgagatgtcatac

SEQ ID NO: 239 - DNA, 252 bp, Ctenocephalides felis
acgatacactcatcccattttatacagaaaaacttgataaaatagcgaaggctaataatggccatttagctcttggaagactaacttgggccgactttgttttcgccggagttatcgaatatatgagtttcatatctggaacagatttccttggaaaatatgcaggattcaagagtgtctttaataatgttgcaaatttgccgaacgtgaaggaatggatcgccaagaggccaaaaactgatttgtaattgt

SEQ ID NO: 240 - DNA, 500 bp, Ctenocephalides felis
tttttttttttttttttttttttttttttattcaactcatcaattacaacatcaacaatagtattaacatcagccatagcaccattaccagtatcaccgcacaccaaagtcttagaaatgcaaggcacttntatatacccccaatcttttaaagtttttacttgtggagcggttatggggtgatcccacattctcgtattcattgctggacaaaacaggaggggcttggatgtgttccaggctcgaactgtgcaggttaggaggttgtcacataaaccatttgatattttagccaaagtgttggcgtccaacggtgcaatgcacatgatgtctgcccatttagttaaatcgatgtgtaaaacagggtcaccacgtttgttccaaaatttccattcatggtcatctgtgtatattttgacggtttggggtatttctgattggtcgaagaagtgttttgcatattctgttactataactgaatttctatatgtatattggag

SEQ ID NO: 241 - DNA, 498 bp, Ctenocephalides felis
aattttattgtatttatatacagataaaaattgatatcaagttagataacaaaatataaaatttaaaaatcaaaacatatttataaatttttttggtcttatttctagaatttattcagcattagaaacattttgaataattttcttgaatattgtgatacctcgaaggaaagtttctgtatctaaatattcatcatggtcatgcagcaatactggcgtgttattcatgggagaaaaaccaaaagccggcagtccaatttctcttatatatctgctatctgttgcagctggaaaaacttgtggttcaagaacaagtcccatttcatcagtagctcttttaaatgctgtccaaaatttattgctttcattcagttcagtgtttgctatcagtggttctttttgtcaaattctatttcaacatccttgccagcttctttgcaccattttcgtatcttttcttccaattccttgtggctaaggatggtgtaatacgtatat

SEQ ID NO: 242 - DNA, 500 bp, Ctenocephalides felis
atagtcttgcttacatgaaaatttgattttataaaaatatttgctattatgcattagcaagtagcatttttgcacataaatcatacatattttaccatatgttggttatattacattattaaagcgttaactccatacatctgagctatatcttttctgtgcttccattttcttgatgtaagcttgagcttggtgtcattcatgttgcctttggacataatcactttcaaaactatgttgcgaacatcacttgccatagtccgggcatctccgcaaatatataagtggccattattttcaccaatgacattccataactcatcaccatttctctctagtaaatgagtgacatattccttttcagctttatcccttgagaatgcaacatgaattttaagagcgcccttattaatatattcttgaagntcctcttcatataagtaatcttcagacttcttgcgcaaccaaagtataagatagtatctccaacagttttatct

SEQ ID NO: 243 - DNA, 364 bp, Ctenocephalides felis
ttttttttttttttttttttttttgggagtaaagcacttttaatgcctgntttctttagtncttctattaagtctccagattgatgcatttgcaacatgatgtcacaaccccctacaaattctccagaaatataaacttgtggaatagtcggccaattggagaaatccttaataccttgtcttaaaacatcatccttcaatacgtcatgactctcatattccacaccgtgcatcctcataatttgaaccactgcattgctgaaaccacatttgggggcttcaggaacacccttcatgaaaactaccacttttttgtctttaacaagcttgtttattctatctgagatcgctgttgtgctgcagt

SEQ ID NO: 244 - DNA, 535 bp, Ctenocephalides felis
rchsncnamtydnachcksmcratndatstrandsncatttgtcttcaaactgtttggagatgacagttactcggacattctcaggtataaattcatcaacaattgactctataagtttagggtcccagtgtgtcattagcgaaggaccgcaaagaacctcttcaaatttaaaatgcatcagattcttgactagataaacaacataacttcttggttgttctttatctctgaacttaaagttcatatcgntaattgcctttgattcatcaaatatccatttttgtggtgtttcctttttcagcaaattaatatactgaaaaactagtctgactatatcatcaacatggtttacgccctcttctgttaaatctgcatctagtttgaagaaaccaaatcccctcctctgaacagcaccgcaagataagcttgaactccaaccacgtgctttcaaacatgataagagactgccgggtccctcatgcccaaaaagatgacctaaataatttcctggtgcagattttctaaaaggctcaa

SEQ ID NO: 245 - DNA, 497 bp, Ctenocephalides felis
ccgactgcacctgcttctcacaattatgatggtggtttccaaaccaaattgatgcacaaagacttaggcttggcctccggagtggcatcagcaaccttgacaccaattcctttgggaactttggcacatcaacttttcacaactgtcatcgcccatggtcttggggacaaagatttctccataatttacgacttcatccaggaacaaggaaagaagaaggcataaattgaaaaataaaaaaaaaattggatactgttgaaccagaaccagaaccaattttctcctaaactaacataatatggtgcctttgattaaatcaataccaatggtaatagaaaatttaaaaaaaattccagagatccaaaattaattaatccattagagtgccttcgataaaatcagtgccaattgatgcaaattcaaaatttaaatatgtttttcaggataaaataaaaaaattactngttataaaaaaaaaaaaaaaaaaaaaaaaaaaa

SEQ ID NO: 246 - DNA, 306 bp, Ctenocephalides felis
ggaaagagtttggagagctggatctccggcgatncatcaggagactacaagaaagttcttctggacgctggtcaattaattaaataacaaaaacaaacaataataggataaactcacttaaatgcaaaatcagtgtaattaaatccatcgatcaatattaataataatatataataaaacacaacacataatcagataaaggacanttttgttaatcgagtagaaaattgaatcanttttctattccaacantttatttttattatgtgttgtgtttttaattgttagtctttttgcacaaaaagt

SEQ ID NO: 247 - DNA, 498 bp, Ctenocephalides felis
attctggcttggactacacaatggaaaggtctgcaagagctatcatgaagaccgcaatgaaattcaatttgggattggacttgagaacagcagcatatgtaaactctattgaaaagatcttcacaacttatgctgaagccggtttagccttttaagattaattatagcattttacttatagataacgataccagtgaaaaatcattacatcaataagctcatagtgcaaagttccttgccagtttaatttgttttacatacttaaatctattaatctgtacatgaaaaaatcactcattagaacataatgtaaatgttataatatttgcacaatcaaagtaataatgtaagcacgcaatatgtgaagaacgtgaatggtaataatctttatacatttattcatttaatataaatgaataaatgtgtaagtttgaattatggtactttaatatgnattcaagcataaatttcagcgtgataattttagttcgcgcgtcg

SEQ ID NO: 248 - DNA, 549 bp, Ctenocephalides felis
ctnagctcgaataatttcagtattatcacccaaaagttaatttaaaatgccgacatacaagttgacatacttcaacgttaaggctttggctgaaccattgcgcttgttgttgtcttatggaggagccgattttgaagacgtcaggttggagaaggaaaactggccagcagttaaaaacacattcccattcggacaagtcccagttttggaaatcgacggtaaacaaataaaccaaagcttggcaattgctcggtatcttggcaaacaattcaacttgggaggcaaagatgccttagaagatttggaaattgatgccatcgttgattcaatgaacgatttcagactaaaggctgctgtcgttatttatgaacaagatgaagcagtgaaagccaagaaagtcgaacaattgaccaaagaagtagtaccattctactttgaaaaattcgaggctatcgccaaaaagacaatggcatttagctttgggaaaattncctgggcagattcgtgctgctgtcaattcgaacatggacttatggccgactgttattc

SEQ ID NO: 249 - DNA, 498 bp, Ctenocephalides felis
ttattattttgttatatgttcttgatgattcttttggtattctggttctttctgganccgtgatgtttacgtaatatataccaaaacgctctgtgaatccacgaagccattcaaaattgtctataatgctccatagggcatagcctttaacattgcagttatcaataattatggctttgagcatttcattcaagtaactacaaatgtaatgaactcnatcatgatcatccaattgaccatgatctgagtatccgttttcggtaactattatttcaattccagggtattcattttgaacccattttaaaagttttcgaaatccttctggaacaacttttaaccaagatgatgctgcactgggccatgaggggtccgattctaattttactttctgatcagtataccaggtgttcggctttcctgaaattgcattggatgctaggcgagatgtataatggtttaatccaagaaaatcagcaagtgcctttaatatgatca

SEQ ID NO: 250 - DNA, 498 bp, Ctenocephalides felis
ttccgatctttngtttatgacaccatatcatctcgagaagttacaggaactgcaagatatgatatgatgcagttgttaattcaagctaaaaaaggaactcttcaagacgatgatttaggggtaactgctgcacgaaataaagaattaacaggcgatgatataacatcccaagctttanttttcctcataactggagtaataacttccacttcaacaatgggtttcggggcctatgaaatagcaaacaacgaagaaattcagaaaaaattgatagaggaagtagatgaggttagaaagaagcataaaggtgaattatcttatgagataattgataagatggattatttaggcagagtaatatcagaaactttgcggaaatggccgccgggaattattgctaggaattgtgtgcaaccttatacaatcacggataataaaaatagaatcacatttaattgcgatccaggagctgtnatatatgttcccacaatagccatt

SEQ ID NO: 251 - DNA, 175 bp, Ctenocephalides felis
cattctactttgaaaaattcgaggctatcgccaaaaagaacaatggacatttagctttgggaaaattgacctgggcagatttcgtgctggctggtcaattcgaagcatggaactttatggcccgcactgatttattcgccaacaccccctcattgaaggctgttatcaacaatgt

SEQ ID NO: 252 - DNA, 549 bp, Ctenocephalides felis
ctttgaccttatatcattttgcaccaagttttccgtcacgagcagcgctgttaactattagagcactaaatcttaaggttgatataaaagaagtaaatctgtttgctaaagagcaatttaaaccagaatttttgaagattaacccacaacattgtgttccaacattagatgacaatggttttgttctttgggaaagtcgggctatagctacttacttggtccaggcttatgggggtgaaaaatacagttccttgtatcctcaagctgctaaagaaaaagcagttgttgatcagagattatactttgatgctggagttttatttcctagaattcgagccatttgctttcctattctatttttgggagaaactacgatttcacaagacaaaaaagaccaactaaatgaagcatttggttatctagatggttttcttgcnaaacaaagtgggtagctggagacaactttaccgtacagataatgcattctggcttctgttctagcatacaagctgtggttcgatatttcnaatccctctgtgctctgggaag

SEQ ID NO: 253 - DNA, 549 bp, Ctenocephalides felis
atanattagaaaaatgttagcaagacccttactgccacaaaatccaaaacaagccccttcacattctgaatttgtgatcagtgaccgtgggtatggcaaagattttgtaaaattattacatgttaaacgagatggagaaacacatcatattagagaatttgaagttggaactcatttgaaacttgcttcggatgtagattacctaaagggtgacaatgtcgatatagtagccacagactctcaaaaaaatacagtgtaccttttggctaaccaacatggtgtgaatacccccgaagaatttggcttgttattatgcagacactttttgcacacctacccccatgttctagaatgcagtgccactgtggagatgtacccttgggaaagaattaagggtagtggtcaaccagaaaggcagcataagcatgcttttatttttaacccttcggcagtcagacattgtgtggtacacagaaaaaatacgaactccggcgtcgaagttgtttgaaggatctcgtgtctcaaaacacgcatccgattcctggntcg

SEQ ID NO: 254 - DNA, 549 bp, Ctenocephalides felis
gaattattatcatttgcattcgctttacttggcttgcataagtacgattgatttggtgctaattcgattcagttttgcatcagtcacagtcaaagtcggtaataaaatatggttactaaagcagtttgcgttttaaacggggaagttaagggaaccatttacttcgatcaaagcggtccagaagcacctgtcacactaacaggatgcgttagtggtttaagcaagggtgatcacggtttccacatccacgaattcggtgacagcacaaatggatgtatttcagccgggccacattttaatccccacggtaaagaccatggaggacctgattctgctatcagacatgtcggcgacttgggaaatcttgtagctgatgccgatggaaacgctaaagtgaaaataaccgacagtcaaatttccttacaaggtctatgagcgttataggcagaacattggtgtcatgctgatcccgatgatcttggcttangtggcatgaacttacaagaccctggnatgctggactcgatggntgngtgtattggattgcaa

SEQ ID NO: 255 - DNA, 502 bp, Ctenocephalides felis
tgatgtttgttttatgatggatactcattgataccgctaataatcaaattagcttgttgattcagtccagttcagtcgattcatttgtcggcctgtgtgaccttttatttttcgatacattgctacatattaaagattgttaacaatgccagcctacaagttaacttatttccctgtgaaggctctngctgaacctttacgtatgctaatttcttatggaggagaagattttgaagattaccgattcaatcgtgaagattggccttcaatcaaaccaactatgccttttggtcaagtgccagttcttgaatgggatggccgtaaaatgaaccaaagtgttgccttgtgtcgttacctaggaaagaaatacaatcttgcaggaagtactgatcttgagaatcttgaaattgatgctattgtggacacagttcatgattttagagcaaagctagctgcagcacattacgaagcagatgaggcagtaaaaaaaaaaaaaaaaaaa

SEQ ID NO: 256 - DNA, 549 bp, Ctenocephalides felis
gtttaagaagtagtagaaacagatttgttaaagcagttacaaatggcacctattggagaaccagaatatgatcttgtggttatcggaggaggctctggcggattagcttgtgccaaagaagcagtaaatttgggagctaaagtagcagtcttagactatgtagttccttcaccacaaggaacaaaatggggcttgggtggcacatgtgtaaatgtgggatgcatacctaaaaaacttatgcatcaagcatctttacttggagatgctatatttgattcttccttttatggatggaaatttgataatcctgagaacacaaaacatgattggttttcattaacagaagctgttcaaaatcatatcaaaagtgtcaactgggtcactagagtagatctacgagacaagaaaatcgaatatattaatggctaggatactttaaagatcaaaatctattatagctgattaaagaataaaagtgaaaaaatattgctgcaaaaatttgtatcgcagtggaggacggctactatccgatttcctggacactagagt

SEQ ID NO: 257 - DNA, 441 bp, Ctenocephalides felis
catgcaccactgtggcggtcttgatgtgaatcaaattcactcgttaattcactttgggctccaaaggccctcacagtcgacaagccagctaacgatgccgcaaggtgagaatatgcgggacttcgggttattccttcaagacgtttaatattttttgatgtttttaagtatattcttctcacaaatatgaaaactactccaagaacgccgacagctatcaaaaataatggatttacagttgccgttaatattaaagcgccaactatagtcagtattatctgtgatgaatcaagcagggctttaggtaaaaattcatcaatagcgcccatgtcttttgaaaatctgttcataatccgtcctgaagggtttgtatcaaaaaatcgcatagttgtttgtaaaattcctttgaacatagaatcatgtaatcnttgagaaacccgt

SEQ ID NO: 258 - DNA, 438 bp, Ctenocephalides felis
aaggcgcgataacacagaacgataatgcttaggatatcaataaagtaaaattaacactaataatgtcgattctaatcaatcatcagttcgaaatggacggatccttgtcgatccttgttgccaccacgatagatgatgttcctggcccaggcacgacattccacgttgatcaaacgtcccactgtaggtcttttgaattgaacagcaactaatggactaagataatctcgttggtttctgaatggataataatatccagcaaatcccatgcttggatacatttcaactgggcccaaattttctcgatcaactggattttctccttgacacgaaacccaaatttgttttctctcatccggcttgagactttgtatgtgatccttcaattccataggcatatcttcaggcagcgtcgccacatcatcataataatccggt

SEQ ID NO: 259 - DNA, 323 bp, Ctenocephalides felis
catcgcctgtgactgccacgacttctctgctttcactgacattgctgtcgataatacctttgaccaatgtgtatttgtcagtgggcgaagatcttgccaaaacacgtaatttaggccacactttatccagcagatgttgttggacatcaccgttgctgtctctaatacgcctattgaattcttttccttctaaaatcagaaaatcttcttggggtttcaatattccacatttcgtagcaatagaccttgcagtgtttatattatcaccagttaccatacgaacagttattcctgctttttgacatttacgaatagcatcaggt

SEQ ID NO: 260 - DNA, 475 bp, Ctenocephalides felis
ggcagctctaggaggatcaatcatagacatgagtccaacaaatctaaggttttcaattgggaagttgggatcatcgctgtcgaatttgaaacctaaggggaatttgtctgtaggcaacatgagatcacaaaagcccaatacacgctctccaagaccgcccaattccagatatgcattattgaaagcttctttcatctcttcatccagtagtttttcctttcctccaatgaagatggtggaacatttttctaagattctttcaggagctcctttcataaccattacatgacgggggtctgacgcatcttcagtttcgtgaatggaaacctggtatttgtttgtggagttaaatggaatttcacagactttcttatttcgttttcgaatagacataacatctcctaaagccagttccatacatttgagaagagcagcttcagatgcatcancactgacttcttttttcaagatgggt

SEQ ID NO: 261 - DNA, 498 bp, Ctenocephalides felis
acaaaacaaaatttgatcacaagccttgccactttttttgtatcacacagcctgaaaatatgctgatttagatatatgaaagataaatagataatttttttcattcatgataatctgccttttttatatctagaatattatttattaattttgattcggaatatggcttagattttaaacttgtcaccttttttacagttcatgctcaatggctaaacatgttcatgtcttttagattatttttttacatgcttattcagactttctattataacatgcgtcacaaacccttttaggttcatgccaatcccgttctggaacaggccttcttttcaaagagcatttgttgcaaacagcttgaccgcaagcacgacaatggtgccttctttgatatgttaaaaacgtccgttgctggtctgatgttgcagccatcattgggcctgttgtatttaaatcactattaatgcttgtagtagtanaattacattcagaatcgga

SEQ ID NO: 262 - DNA, 279 bp, Ctenocephalides felis
ttcaagctattgcaattactttgtgtgttgttattggtataacactctttacattacaaaacaaactggatttatcaatgcttccagcagcattgtttactggactttgctgtttattggtaggtggtatcattcagatattcactcattcaaccatttttgaattagtgttatgcagttttggtgcactaatattcagcttgtttttgctttatgacacgcatgttatgatgacgacattatcaccagaagagtatattttggccacaattaacttgt

SEQ ID NO: 263 - DNA, 344 bp, Ctenocephalides felis
aacctaaaaataagcaatttacatacaagatcgacacaagtcatgcaacgggaaatattttaagaacttataaccgaaaaagtagtgggttgcgaaataggccactgtgggcactcaccatttgccctgtattcgtcctggactttgtagaattctgctaattccttacccgagcacaaaggagtatcgacttgggtagtttcgttaaatctcgaataatcgacttcgtagcattgtctttctttattgtagttgacgactgggtcgaacctgtggccccacaatatttccgtattaatgtaacttgatcgagcttgtgtggtctgtcctgtagattcaatagt

SEQ ID NO: 264 - DNA, 477 bp, Ctenocephalides felis
attaatttaagaatctaatggacatcttttgttcaacatctgtgcgttccaaagctttacaaaaatcatcaaatgagatcatttggtcaccattttgatcagcttctagaatagttctttcggcaatgcttgacaattgttcttcacttatatttgcacccaccatcatgtgtaaaatggcaagaagttcatcccgagatatcatgtcatcattgtccaagtcatacattttgaatgcaaatctcaatttttcttccctgctgttcaatttattttcccgattcttcttaatgggtctgaaatgtgctaagacttgcataaactgtaagaaattcaccctgtcatcatgactttgagcaaaaaatgcatggacaatcctatcacctaagggatttattgcgagttcgggtattctcaaaaaatcatctcgtgaaagagttccacagtctccacgatctagagatgtgaatcttgagt

SEQ ID NO: 265 - DNA, 377 bp, Ctenocephalides felis
cnaactttgtcctgttatcccatcgatcatgcgtctagcattggctatggctagatttaagtccctcctcanaacaaatccnacaagatactgagattctctggaaacaacaactggatatccattgtgctcagntnctttcantaaaccttcaacatcatccacagtcatcgagtcttgagtgattacacttaatgtttcattcctcttgggttgcatgacatctgcagctaaagatgtatgtgcaaattcatctttactgccaagaatggatatccattaagctgtatatgggcatcatatataccctgtctgccaaagcatcaccaacccatttggaagccatagctgctgccattaagggcacgatataacgt

SEQ ID NO: 266 - DNA, 222 bp, Ctenocephalides felis
tttctttagtggtgcactgtagatatccactttgatcagcgcacacttgatctgggctacaggattccttaaccggatctgctcctatttccggacaatactgcatttcgggtgaactgcacgaattcacgcaactaaattttacttttttacatttttgctcgggtttcggtacaaaatgctatacagttacatgtcctgcacagcctaaggtgcttccgt

SEQ ID NO: 267 - DNA, 209 bp, Ctenocephalides felis
cnaaagaggnttcaggaagctcttcttcgtcncctgattttggancccgagttggttcaaccaattcaccaggatcgtgaatctaatgaacatgaagaacaattcaacaagcaccatnatnacaagcancacaaagctgattatatgaatcacatgagagtcaccgacacttcngcaatcatggctggttcttttgctgtgatagcggt

SEQ ID NO: 268 - DNA, 178 bp, Ctenocephalides felis
aaccaactagagctaagaaaaaagccagcgatagcatagaactgctatgttcccctccaaataccactgttgttttatcatataaaaatgccatangtatggagctaatgcatccaatcaccatcaatatatatatatatatgaagagtcttttatccttcctgggtaaagtttctgt

SEQ ID NO: 269 - DNA, 238 bp, Ctenocephalides felis
tttgttttactttatgtgttatataaaaaaatattatggttgaacacaggctcgcaaatatgataaggcatttaagaattttacaatttagatttttttaaatccatgaatatatttgttctaatcaaaattattcattttacgcttaattttattggttgaactaatagatagatagataaaagatatagagttaatataaaaatgaagaaaaaaaaaaaaaaaaaaaaaaaaaaaa

SEQ ID NO: 270 - DNA, 326 bp, Ctenocephalides felis
cgcaaggtatggcatatgctttgttagcaaatgttattccaacagcaggattatatgtggctttctttcctgcattggtttatgtagtttttgggtcatccagacatgtatccatgggaacatttgctgtagttagtataatggtaggaaaaattgttcaagaatacgcctattttccagacggtgtagagaaaaatacaggagatacgaccacaattcctgaccctgatgtgcaatacnatcctacagaagtggcaaccgcagttacatttctggctggaatttatctgcttatcatgtggatttttcgtctaggggctcttagt

SEQ ID NO: 271 - DNA, 549 bp, Ctenocephalides felis
tcgcaagaaatgttcactctaggaatatgtaatatatttggcagtttcgtgaagtcgatcccaacttgtggtgctttcaccagatcagcagtcagcaatgcaagtggtgttcgctctccaatggcaggcttgtactcaggtactatgacgcttttagcgttaagttttctcactccatacttttactatattccgagagcaactctttcatcagtgttgatatgtgctgttatgttcatgtttgattggcaaatagtgatgccaatgtggcggactaataaattggacgtgttatttatggggtgtacatttgctgcatctttatataaaggagtagaatttggcttaagtgttggtgtaattctgactttatgtcctttgctctatttgtgggcaaggcccgaaattaatcacatatctaagtggacacccgaaggtcttgaatatcgcgtgtatgcccagaccaggtctttactttccttcggttgactttttgaaangagaattgccaaagttctttaaattttcnggtccntgatttagactgtc

SEQ ID NO: 272 - DNA, 549 bp, Ctenocephalides felis
gtnttttccattgagtagcgaatttgcccgtcttacaatattaaacgtgaattcgttttgccgggtcgtagtaaccaatttaatataatggctcctccaccatacgcagacttgggaaaacaagctagggaggtatttaacagtggctatcattttggtcttttcaaattgaatttgaaaactaaaactgcctctggggttgaattcacttcaggaggaacttctgaacatgaaactggcaaggtatttggatctttggagacaaaatacaaagtaagtgattacggtctcactttttctgaaaaatggaacacagacaatactttagctacagaagtttccatacaagatcaaatagctaaaggtttgaaagtatcattcgactgctctttcgcaccacaaacgggaagcaaaactggtgttttgaaaactgcttcttacatgatagtgttgcagtaaatgctgatgtaaatttgaattatcaggacctttgatcaatgccagcgcagtagtggttatcaaggtggtggccggtatnaactgatttnc

SEQ ID NO: 273 - DNA, 549 bp, Ctenocephalides felis
ggcaaaaggatctgccaaacctgcaagccggcaagaaagatagttcgaaacgatccaattccagcgatgaagcgacgcatgtaaatcataccggggaatgggcgaggccgcgcagcgagtcggcgggcgaccctgacgacggctgcgggaacacgaccgactcgggaggaacgtacgtcaaacgcacggggttagcgttatttctgtggtacgcctcatgcggaggagttcgcgagtggtgcgtagcttggtggcactcaggcagagaggaatactatgaaccagatccggaagaaccgtcagatcctggatacgcgactccggtctctatcgagacgccgttgcagagctcagtgtcgagatgcacttccctgaatgtgatacgcgacccatacatgacgacaacggaagggcgaacctcgcgctgccgccgacttacctcttcacgcctcgtcgcgcaactactcaagattcggtttacaccatctgatcaggctcccggggaccagacaaagacggacaagatcgcacccttcataaaatgatatc

SEQ ID NO: 274 - DNA, 549 bp, Ctenocephalides felis
ggctcttggtcgaagaggctgttaacgatgataacagtgtggtggctttgtctcaagctaaaatggacgaactgcagctattcagaggcgatacagtattattaaaaggcaaacgcaggaaggagacagtttgcatcgttctctctgatgatacttgccccgatgaaaaaatccgtatgaacagagttgtacgtaacaacttgcgtgtccgcttgtctgatgttgtttctgtgcagccttgtccagacgtgaagtatggaaagcgaattcatgtgctgcccattgatgattctgttgaaggcctaacaggaaatctgttcgaggtctacctcaagccctacttcttagaagcctatcggccaattcacaaggacgacacatttattgtccgtggcggtatgagagcaatagaattcaaagtagtcgaaacagatctgcttcttattgatcgtggtcctgcacagtcattcattgcgaaggggatccaatcaagcgtgaggaagagaagagctcnatgctgcggtatgatgatattgtggtgagaaacat

SEQ ID NO: 275 - DNA, 549 bp, Ctenocephalides felis
ttgacaagtttcgatttggttagttcttgtacttaatatggaatcaatctcatctgaactgactgaaccacaaacaaattctaattcatttaccgttgatcaaatagaaattgacatattgcccactatatatgatatcatacgaagtgttgaaagagatccacatgatagcgctggcaaaaccagagaatcacaagattgcagtgtgaaggtattagacttacaaaagaagttagaaaaaattcgaagtcaagttactcagctacctggaattgattataataaagaggaacaacttcaatatttagaaacacttaggaaacaattaaaacttaagcaagagcttttgcacaaatacaggactatgtacacatttgattcaatgaaaatataaattgtttaaaatgcctctgcgatctctcatgaattatttgctgaataacgacgtttagttcagaagttgctgaatcttatccagtcgaagagctggcagttagccatttcgctatgatagatcaaaatcaatttagggacacactgagaagctgg

SEQ ID NO: 276 - DNA, 549 bp, Ctenocephalides felis
ggctcgatatcgctggaaaaactttattatcgatgtgatttatcaatggtttcgtgagaatattctatttgctttgacgaaaacaaaaaactgattagtttattaaataaatagtatatgttaatatttgctgattggcgatgacggcagagaaagcggacttttccgacagtcttctgagtcggacgggagagcaggtccacagaccaacatttcgctctcatgccaaagactgtgctagtgcttgttgcaccagaaaaaccttagaaaggcatctgcctatagtaaattggttaccgaaatacacctgggaaaaattaggcagagatgccattgcaggtttgacagtaggtttgacagcaataccacaaggtattgcatatgctgtagttgcaggactagaacctcagtatggtttatatgctggtttcatgggatgttcgtgtacatattcctaggaggatgcaaagatgtgacataggcccacggncatatggctctatggtgcacgctatgtcaagactgggcctgatttgcaatctgcccttt

SEQ ID NO: 277 - DNA, 549 bp, Ctenocephalides felis
aaagtgatgcaacaattattttcaaaatacaaaagtgttaaaaaatgggcgttaaaaatatatatttatactgcattctgatatgcctgctacattatgcatcttataccaaaactgaatctattaccaacaattctttggaagaattgtacacaaacacttctgccaaaacagattccattactcttttatcaaaaaccagtctaccgcctgatcaaaatgccacgattgaaaatcctgatccagtgcttcctgaaaagggctccgctgaacaagaacaacacagctcgatgtctatattcttcgtgctttgtgtgctggctttagggattcttttaattcatttcatgttacaaacagggtttcagtatttacctgaaagtattgttgtagttttcttaggtgctttaatcggcttgataattaatttaatgtcgtctaaaaatattgcaaattggagaatgaagaaccttttcacccacagcgttttcttagtgctctccgctataatattgaatccggtatattgcataaggnattttttcaaat

SEQ ID NO: 278 - DNA, 549 bp, Ctenocephalides felis
cttgcttagaaaaccatacggaagaaccaaacctctcatatctcgtaccatgatgaaaaatatacttgggcaatctgtatatcaactaacagttatattcacactgctttttgttggtgataagctcttagacattgactcaggaagaggagcagactacggttcattgccaactcaacattttacagtaatttttaatgcttttgtactaatgactttatttaatgaatttaatgctcgtaagattcatggacagcgtaatgtttttgaaggcatttttacaaatccaattttttacactatttgggtaggaaccgctgttgcacatgttgtcattgtacaatacggagatctggcattttcaacaaaagggctgaatctcgagcaatggcttggtgctgttttcggcttggtcactattatggggacaaattgtacccagtnctacaagaaagattcctaaaattcttcgtagtntacttnttatttgatacacttcaatgcaagaataactagtttagttctantcataagaatgcanatttagtg

SEQ ID NO: 279 - DNA, 549 bp, Ctenocephalides felis
aattcttgtgtgtagaataaaaaacatatttgaaacgttcatataataaaaagtgcaacatgtcagatgaaatgcaagaaaacggaactattaatggtgaagtgccagaaattgaacttatcattaaggcatccaccatagatggtcgacgtaaaggagcttgtttattttgtcaagaatattttatggatttgtacctgctagcagaacttaaaactatcagtttaaaggttacaacagtagacatgcaaaaacctccaccggatttccgtacaaattttgaagcgacgccgccgccaattctaatcgacaatggcctgccgtgctagaaaacgacaaaatcgaacgtcacatcatgaagagtgtccctggaggacacaatctttttgttcaggataaagaagtggcaacactcatcgagaatttgtctctaaattgaantggtttagtcaaaaaggatgcgtaaaaagcaatagtctgtgacccctgaggaaaatcaacgccatttgggcggcgcggacgagattctacggcgacccatgtntgntc

SEQ ID NO: 280 - DNA, 269 bp, Ctenocephalides felis
agatctactaatgccgcgtttaccactgtcacagcaattccgcaaaccagcaaccacaaatataaatatgatgctattgttaaatgttcaataaatgcacaaattattccacaaatcccgcatgagaccatcacgaatacaagaattggaagctttcccacagagttaataatagcacctattatgggaaatccaatcgcatatccagcttccaacattaaagaatgcataaatgcctgttcttccattgtgtctttacactcggtcgt

SEQ ID NO: 281 - DNA, 489 bp, Ctenocephalides felis
catcaaatattgaaaggaatcgatcatgttcaaatgcctggaaaagttagcagaaaagcccaagagttgattagaaaactctgtagacctgcacctgcggagagactaggatatcaaaaaaatggattgcaggatgttaaaaaccattcatggtattcatcagtttcattcgactgggtgagtctcaaatctcaagaaatgcctgcgccactggtccgcacagtagaaaattcaacagatatgagaaactttgacaaattcccgaagaacagagaatttccacctgatgaattatcaggtttcgatataaacttttaaaaacactaatttgcacacctgataatgttacataaaatctacgtggctgcagcgctgatataagtaattggtattataaatacagatgtcattcttgaatataagaaattatttatatatttgtaacgataatattgaaataaattgttttatatttcgataatataaaaa

SEQ ID NO: 282 - DNA, 498 bp, Ctenocephalides felis
aacatgccctcagcgatttccttanaaatacgatacattaatgatttatctaaatgatcaagtcccttgagatagtttaaangacttcctccttttacgtaacttgtaatcgtccaaatttcttcagaantggtggatataccgaaaaaacatgacaaacgatgatgatctagtgttttcatgatcatagcttccgatttaattatatctaatgaattcacacgataaatgcttattttatgaactgtcacatcgattttcttctttttccatagtgcttgcgaaacaggattataagatcctctactcaagttagacttanactcaatatcttcaactggtataattatttcatcaccatgactattataatcgtcctgcttagngcaaangatttgtcaatttaatgcccactgtatccancgggttatgtntgtnnnttncacacaagcgcangcatactggggaaaactatgtngaattcantagagtaccgtc

SEQ ID NO: 283 - DNA, 498 bp, Ctenocephalides felis
atctttagcaccaacattcgattccaaccacaattgattaagaccgcaatcactcaaatccaaccagttgagaagactgagaggaaggaatactttagcttcaacggtcttcaatggattgcctgataacaaaagtttgtttaaacttttactatttttaaatattctagtatcgagtttgttgattttattattactcaaatctaagctgattaaattgcgcatatgccagaaaatattatattttaaatctttgatcgagttctgagctaaattcagttgagccatggaaggcatttcagcaaatgtatgtttgtctaagctaagtaatccgcaatttactgcttcaaacatataagtggtaaacgatgacaaatttgaatgaaatctaggcaaattcatgagattcgggttgttagaaattttaataacatccaaatgatcattattttggaagacgttgtcaggtaagaaagtaagtagattatgtgtcaagtc

SEQ ID NO: 284 - DNA, 129 bp, Ctenocephalides felis
atcgatctttggcggctaaacatatcttgctgagcgaagccggccgtatagaaatatgtggctttaaggaaatgagagttcttcctgagggccaaaattatataaaagaaaatctcgacaatcctaagt

SEQ ID NO: 285 - DNA, 424 bp, Ctenocephalides felis
gtaaacatccatacatttagggcagtaggattttaccatagcctctccaggcacatcagaaagacctaatggcagcataggctgactatcgcagtaaactctagggcaatatccgaagtctccagattggtatttttctatcatttgagctatacctctatttgttaaaatatatctggcgtgaattagaccatataacatctctgcagcttgttctattgcatctgactgatttggattatcatctatttcatcatcaggtttaaatctaatatcatatccaaggcttgtctatatcgtggaatttgctcattaaggcctgttagattgaatttatcctgtatatagtcttcatccacctcgcaaaagaattcatttcctcgtagaccacaaaaccaagatatccatgagacctcctcagaac

SEQ ID NO: 286 - DNA, 204 bp, Ctenocephalides felis
ggacggccgactcgtccgaattatgctcggcacgtgttcgattcaaatgatcccgctacgttcgacatccaaatgataaacactatctaatcaagtgatgttgtttaattaagcaagtgttagttcgaattcatttttgtgttttgtgtatattataataaatggaccccgaaattcctctgaaaggtgtgactccgggtttgt

SEQ ID NO: 287 - DNA, 446 bp, Ctenocephalides felis
acacgcacgagcactataatcactttgaaacttcatacaccgattgatgtcatgtcgatgtgtggtaaatgtcatgacagatcacagtagcagcaggaaggttataggttgctcagattgtatcctggttcttgacacatgtattactgatgtttcacttggttttctgtggcaattgatggtgggttacggctgtcgttacagcattctgcaactgtggtcctgatgagcttgaggactctatctgctttcggtgacttatttccaaatctgctaaacgtttccataattcatctcgttcgcgctcgcgtttcttttctttctgcgttctcctttataacttgcagtcaattcatcaaatagtttactattcatttccatgaatgnttttaagacattataaactaaagcacaattgctgattccaagctcttttgaaatgcggt

SEQ ID NO: 288 - DNA, 268 bp, Ctenocephalides felis
ccacaggaaaggaggtagctatcaaaattattgacaaaacacagctcaatcctggttcgcttcaaaaacttttccgagaggtgcgcatcatgaaaatgttggatcacccaaatattgtaaaactgtttcaagtgattgagacagaaaaaactttatatctagtaatggaatatgcatcaggtggtgaagtgtttgattatcttgttcttcatggtaggatgaaagaaaaggaagctagagccaaatttaggcaaattgttagcgctgt

SEQ ID NO: 289 - DNA, 465 bp, Ctenocephalides felis
cggcaaatgtccaagcttttttgcctggatccacacgtttggcaaatccaaagtcgaccagtttgatgtatcctttagtatctagcatgagattttcaggttttaaatcacggaagatcatatttttgtcgtgtaaatattcgaaagcttcaataacacaagcggttataaatctagaagttttttcatcaaaacattttgctttatgcaacgccgtccagacatcacctcccagacatgcttccattaggaaatacaagtatttggtatctttatatgtgttgtataatctgcatataaatgggctgtcacaactagccataacatgcttctcattgtaaacgtgctgctgttgttgctgctgaacaatatcaactttctggagacattttagagcaaatgtcttgtctggtgtggatggatgactgacccagttccacgcgaccaaatccgcaacgcccaaag

SEQ ID NO: 290 - DNA, 294 bp, Ctenocephalides felis
ctatattctggctttctaaatactccatgccgtcaataatctgccgacaatatgtagggaaaagttcttcgtctataataatattctctttctctcttaaataatgcaacaaaatgtagtctagtttttcagtaatgatgtaatgttttggagtttcgatccaggcaagaacttgctgtatatttggatgtttcagtgatttacttaaatttatctctcttttaaaattttcatgttcttgactttccacgccatctattgtggttgttaccaagagtggctttctcgaaatgt

SEQ ID NO: 291 - DNA, 203 bp, Ctenocephalides felis
gaaaagcagcaggatttgttgttttccgacgactgtctgacacaattcaatatctactactacaagcttcttacgcaaattttcattggagtccaccaaaaggccatttaaaacgcaacgaaaatgaatttgatgcggcacttcgagaaacattagaggaaacaggtctttgcaaaagcgatattaaaatatttaaagattgt

SEQ ID NO: 292 - DNA, 283 bp, Ctenocephalides felis
catcactgagaagaactcttcggctacggaatatcttcattggaggcgcgttgttggtgcacgcagcattaacaaggttcttgcaattcagcataatgaccagaagaaaaatacaggtactgcttttcattttgattcagtaatagattacttcttgagatagataataatactgtggagaagtaaccttcacatgaaataggcttgggtcttataattactggctttgttctggatattagaaatctgatcacaaaattttattaagttattattatgttaa

SEQ ID NO: 293 - DNA, 500 bp, Ctenocephalides felis
agnnttgcgtannaanccctnannaagcttcntcgagngcnngaattcggcttagcgtggtcgcgggccggggnacaagtatcaaacatgggctacgggggacccgtagattcccaacattctacaaggggcgncnttctttantaaaatatcatccagattttcaaaacgaccgatggattngcccggntnaaaaccaggcacacctggaactaacgctttagttagcggnggaggnggcacaatgcaggatgaccaggtcaaaccgaggnccttgagggtcacatggnccatgaagaccacaagcagtagggaccccnatgagataatgtntgaaattcgaaaagttttggatgccaatggatgcgattatgaacaacgtgaaagggntttactactttgtgtcacggagatctatcacggatagtttagtacaatgggaaatagaagtctgnaaattggcaaactttccttggatggaggtcgattcaaacgcattt

SEQ ID NO: 294 - DNA, 302 bp, Ctenocephalides felis
actgtcatcatcgcttaactccagtaatatattatctgatttcagatctctatgtgcaattccataagctgataaatgggcaatcgcttccaaaagttgagcaaacaaaattatggacgtcctcattgatattttattactactaagataatcatgaagactgcaatcgtatctcttcattaacaaaaacaatgacatatttctaccataaccatcactgttaattctttgtggtaaagctgatggaaacaaactggctgctagtggtaaaccagttggaattctatcagcaaacacgctgt

SEQ ID NO: 295 - DNA, 498 bp, Ctenocephalides felis
aagctttctttttttttttttttttttttttttaaatcggtccaaaaccatcattggnttattcattngtagaaatngagatgttaaaattgactccaatcctnttaataatatcggctgctaccctacttccaaattctgaacaagtttgtaaagtattgtcctgcaagaatttatataagaagccagcgaggaatgcatcacctgcacctgttgtatnttttataagcgccgatggaattttctcgatttcaacagaccattttgcaaatcttttcatcttgttggtaaaatatggtaactggttttgaagcatcagttgctacaactatcttacttttgaagctagtgcatttcttctttagaggcttgtaaactttaatcaaatgctccataacactatccaagttattgaaattataagccttgcctaattctaaaaattgctcagcggnttccaaagactacatctgcagattctgctagcgnttttacatt

SEQ ID NO: 296 - DNA, 227 bp, Ctenocephalides felis
cactacctattgatcctgctatgtttccaacgtggcctgcaaaaagtgaacttggaacaagacgtgcacttgccagtagtcctaaaccaccttcaggaggtgaccagtttaaaacattgggggaaggtgaaggagccgatgcgtattggggtgaacgagcatctttgttggatacaagaaacattccaatgggtgcaggcttctcactcaagttttaataaattcgt

SEQ ID NO: 297 - DNA, 452 bp, Ctenocephalides felis
ggcacgaatatttgtcttcataatcattacccgctcttgtatattgagttttagggatcaacttcttcacataattctcatttataaaacgttggaacaaaactccaaatgttgttttcgctttcgaatgtcgaaatagtgcataaaattcatcgaagtccaaaaaccgtgaatgattagagtcacccaaactcataagatactgagtcgcagattctggaaactcattattatattcacttctctctacaattctttgtaattctctgacagatatcaagttatcattatctgtgtcatactttcaaaatacaattaattattgttaacgtgcatacataaactttgatttattataattttaccttcccgaataggtatctgatatattgatcagtttccctcaacggtatattatattccatctctaattgtgatatccttctctgagt

SEQ ID NO: 298 - DNA, 138 bp, Ctenocephalides felis
ttagatacaagtatttctgatgatcttaggaagtatagaacctactctggaagtaatgttagagatttattaagagctataaggaataagaagcatcattatcatcaactctcacctgatgcattgaaagttttgggt

SEQ ID NO: 299 - DNA, 498 bp, Ctenocephalides felis
aatcattctctctgatatgtgtatcaaaatggcgctatcaactggccaaattgatgtccttcacaatctgcacaaaattagagaacaaagggccaacttggtggacaacactaatcaattcaaaatagttcatatgcttgttttggaatgcttatttggagagtctacaagtattccatgtgaacatttgctaaaaactgtagccgaaatgaaaagtcgtaatgaaatgttcaaaatgtggaaaaaaatagacgatgtcgcatggaaagatgacttcgttaaaggaatagacagtgaaccatctcaagaagatattgcgagaaaagagaatagaaataaaattgtgccaggaagacgaggtcgtgtatttttgtcaagatttccattgacaaaagcagattcggattatataaatgcaatatttgtagatggatttcaaacaaaacgtcaatttatcggtacgcattttnctttacatcatacagttgctgatttctg

SEQ ID NO: 300 - DNA, 549 bp, Ctenocephalides felis
cttntgtttaaatattgtattttattanattattcgttgntattaacgctgngactatagataatatttttaacaatttataattcaatgggtgttagaactgcatgcaggntatttaattaagaatgggcgcttatttatccaagcctgttgtggaaaagcattcgagcgatgaatcgaataacatattaacttgtgcagntagtagcatgcanggatggagaataactcaagaggatgcacataacctgatattaaactttgacaaggatacatcactctttgctgtttatgatgggcatgggggtgccgaagtggctaaatactgtgctgaaaagttgcctgattccatcaaggaaactcaagcttataaaaatggggatntancacaaggtcttaaagatgctttccttagttntgatgctccattgcagaanaaaaagtcattgaaatactcaaaaattatccactttgataatgacattaacangcaagtcagntgaatggactgangatgacggtattanatgatcctcagaatctgngaag

SEQ ID NO: 301 - DNA, 547 bp, Ctenocephalides felis
agtttctacttttgacatcttcattcattgtgccgacaaaatgttgtaaaatgctgttttataagtgaattttatacgaataacttagaattatattttattttattgagtgcatgtgtgtgttcgagaagtctcaaaggtcaatttgataaaagtacaagagtacctgcaagatttttgtaaagaaattatataataagtgttttattaatatattttatacaatggctttgaacaaattgagtatcgagagtgtggatttggaaggcaagaaagttcttatgagggttgatttcaacgttccgttaaaaaacggtgttatcacgaacaatcaaagaatagtggcagctttggatacgattaagtcgctttgaataaaaatgctttgagtgttattctgatgagccatttaggacgtcctgatggcttctaaaaaggaatacagtttgagacctgtgcgaggaattgaagaactattaaacagggatgtgcatttttggaagactgtgtgccccaaagtagacaagagtgcataatgcaagcaagg

SEQ ID NO: 302 - DNA, 549 bp, Ctenocephalides felis
aagcnggtaccaatgccgaaattgaattaaaacgcggcgaaaccatcaaactgaccaccgacagagcctattccgaacgatgcaccgatcaaattttatacttggattatgaaaacattgttagagtggttaaaccaggaacaaggattttcatcgatgatggcttaattagtgtcatagtgcaaagtgtagcaacaaataccttgatttgccaaattgaaaatggtggccttctaggaagccgtaaaggtgtcaatctaccaggagttgaagtcgatttaccagcactctccgaaaaagacaagcaagaccttcgttttggaattgagcacgacgttgatatgatttttgcttctttcattcgagatgccaacgctttagatgaaatcagagcagtattaggagaaagaggacgccgaattaaagttatctctaaaatagaaaacaaacaaggagtagctaatgcagatgagatcattagggcttccgatggttcatggtgccgaggtgnttgggaatagaaatccgcagagaaattgtcttgacaaa

SEQ ID NO: 303 - DNA, 547 bp, Ctenocephalides felis
aatataataatgatggtatacgtttgataggttctactgctcagtttttaatacagtattatattatcgaattctcataatttcatctaattttgagctggatagagtgctgattgaaatatccaaatttcagccttgtcacaatcagaatgactgataatagcgatttagatagacaaattgaacaattaaaaagatgtgagattattaaagaagctgaagtaaaggctctttgtgctaaagccagagaaattttggtagaagaaagcaatgttcaacgagttgattcacccgtcacagtttgtggggatattcatggacagttctatgatttgaaggagcttttcaaagtgggtggtgatgttcccgaaacaaactatttgtttatgggtgattttgtggatagaggattttacagtgtggaaacatttttattgttgttagctttaaaagttcgatatcctgatcgaattcattaataagaggaaatcatgaatcaagacaatacacaagtatatggatttatgatgaatgcttagaaatatgg

SEQ ID NO: 304 - DNA, 549 bp, Ctenocephalides felis
aaanaattgatcccaatggagatccatcacattatgatataagatctgatgtctggtcacttggtatttctttattggaattggcaactggtagatttccttacaatacatggggaacaccttttgaacaactaaaacaggttgtgaaagatgatcctcctcgtttaccagccggtgtatatagtgaacaatttgaaaacttgatagaacaatgtttacaaaaacaatttgaacgtagacccaattatcaacagttattgcagcatgaattttgtgtgacccatcgagataaaccaacagatgttgcatcatttgtgaaagatatactaacgtttgatacagtacaataaatttgttcttactaatatttagtattaaactaataaattataataatgtagttaacataacttgttgctgttagattttttgaagttataatcctgaaacttgcaagatttgtttcaaatgtaaaattatatataaaatcatatttaacatcatttacatcatatacatgatattttgttaaataaacctcaattctcg

SEQ ID NO: 305 - DNA, 549 bp, Ctenocephalides felis
aactcacgcaactccagccgcgctctacgcgagaagcgttcaccgggattgggaatgcgatgtgtccgtgcccgaaaatttcagggagatgagcggcttaaaggacatcgccaggcaacttgtgcaagaagcaccaggcaataaattgaacgtaattttggcgggtggaagcgacatgatgggcagcagccgcaacccggagtcggcgtgccaacgcggagatggacaagatttggtagcagaatggcttcattcgaggactagcttgaactcccagggcgtctatgttaatacgactggtggacttgaaaaggcgaaagtgaatgagatcgattacttgatgggtatatttgcagcagatcatttgccctacaatgcagtgagggataagggtcctaatggaactccgtctttagcaaggatgaccaaacaagcattaggaatattacaaaggccagataaaggattcgtttaatggtgaaggaggcgtattgatcacgccatcataaaattttnacaattagctcttgcgaactgctgaatttgcga

SEQ ID NO: 306 - DNA, 549 bp, Ctenocephalides felis
gaaaaatagaacattatcgacgtttaaatttctccaaaattgttaggttatgcaaaaactttgtccacaaagactctgctactacaccagagattgataccattttctcaaatggacgcaatttaactatatcaactggcaaatacgctcgattttgcgatggatcagctgttgccaaaattggtgatacttcagttatggttacggctgtgtcaaaaccaaagtctcataatgttgggaattttcttccacttgttgttgattacaaacaaaaatcagctgcggcaggacgcattcctacgaatttcttaagaagagaactaggtccaacagaaactgatatattaacatccaggttaatagatagatgcctcaggccattatttccacctaactatctcaatgaaacccaattagtttgtaattcgttagccgtgattcaatatacaatgctgatgtgccagctattaatgctgttcagctgtttgcgtaagtgattaccatggaatggccaattgngctgtaggatcggttaaaagattcgactga

SEQ ID NO: 307 - DNA, 550 bp, Ctenocephalides felis
ctcagttttagttcaacagcaggcgaagttatcgtttccggagcagaagacggtaaatatcgtgtttggaacttgcaaggccgacaactgtatgggggcaatgcacaccatcaagccgccgtgacttctcttgcttgggctccatccggagcttattttgctctcggctcttacaacggaattcgcctgtgcgacagcgctgggtggtcgcatgctttgaataaagccgaaactggttctctgtacagcattgcatggtcacaagacggaactcgtattgcagcagcatgtgccaatggacatgttttattcggaaatattatagaaaaggaattgtgcaaatacagctataacattgttctaactacagctagtactttgtcagtgagcagtataattgatacaacaataaatgaagtgcttgaatttacagatcgagtaacaaattttgatataaactctgagcatctgtggtcactacaccaactcaatgcntatatataaaattgacgatttattcacccacagtgttgagttgaaggatggtgta

SEQ ID NO: 308 - DNA, 549 bp, Ctenocephalides felis
aaaatctttcatcatgtagcgtataggagaaatttatttgcctaaaatctgcgttattgatctttggcttactaatcaaaagtgatcgacttctttcttgtagttttgtagtagtgtttaaatcatttgttaataatggaaattgtgggtgatttcgagtataacagcaaggatttaataggacatggagccttcgctgtggtctttaaaggaaggcatagaaagaagacgcatcttgtggtggcaattaaaagcataacaaaaaagtctttggccaaatctcaaaatttgttaggaaaggaaatcaagattctcaaggaacttactgaattgcaccacgaaaacgtagtcgccctcctggactgcaaagaatctgctcacaatgtatatctcgtaatggagtactgcaatgggggtgatctagctgactatctcagtgctaaagcccttaagcgaagatcaattagacttttcttgccattagcggcgcatgcganttnatgccaaagctcgactcggactgaaccgagattctctgccatccgcagc

SEQ ID NO: 309 - DNA, 308 bp, Ctenocephalides felis
ttataaataaagaacaagaactgaaagaaaaatacaaagatgatcaaccgattgaatgtccatactggggcgggtatatagtaatacctcgatctattgagttctggcaaggccaaagtgatcgcttacatgatagaataaaattccgaaagttgcttccaaatgaacaaatagatttgaatttaacacatgaagcagataatggatgggtttacgaaagattatcaccttaaacttaaaattatttatatttttatgcaggaaagccaaaataaaaatagttcaataatttgaacttataattatgt

SEQ ID NO: 310 - DNA, 437 bp, Ctenocephalides felis
cacgattcaatatcgacgatttcaaaatttgctgcgttgactttataaattttataattcggatttcggttaacgtaagttgtaatacttcctccattgaatgcaacattaataggatgtgatgaattcatagaatcatagaaaatcttaaattcgtcattatgtgtgtggccattgaattgtcctgttattatatgcgaaaatctttggatgatgcgcctatattctctgtcccaagtaatgaagttagtgggttcaccaggaggaacatgtcccaaaatgtgcactttttcattagttctttctgcttctaacagagtatcatgtaaccattgcaattgctttttggggaatgcaggatcatacagtaaccacaaattataaatataggccacattattattcaacgctatgactcgtagtccaagtttaggtgt

SEQ ID NO: 311 - DNA, 173 bp, Ctenocephalides felis
cgaaacccgagcaaaaatgtaaaaaagtaaaatttagttgcgtgaattcgtgcagttcacccgaaatgcagtattgtccggaaataggagcagatccggttaaggaatcctgtagcccagatcaagtgtgcgctgatcaaagtggatatctacagtgcaccactaaagaaagt

SEQ ID NO: 312 - DNA, 337 bp, Ctenocephalides felis
cgtcaagtccaatccaaaagtggaagctttttcaggaaagttactaagagaggtgtcatttccaccagtgggatcgagaaataatcgcacaattagctgtgttcgtgccctggaccaatatgtaaatggccaaggaggctatgccactcttgtcaatggtggagttggctggaaaaatgtaactttactcctatcttctcagactggcaaaggatttaacttcttagttgaaatttggggatattagattagaaatataatgaaaatgtgaatatagaaaaaaaattaaatatacaatagtattttagaaaaaaaaaaaaaaaaaaaaaaaaaaaaa

SEQ ID NO: 313 - DNA, 498 bp, Ctenocephalides felis
attgaagaccgtacacaggcctgttcaatctggaagctaagggttctaagggtgctacaactccttcaatcgcatgaactaagaacaaaggtttcttatcactcttgtcatcctttgatgtcaacctcaacaatactttttctggcatgagttcgttactggcaaagctgacttgtttgtcttcgctggtgactgcaccattggtcgttgcagaagtatcgccaccacctgcacctaattctttcagtttaccaaaggtgagtgatctgatttcttgggcattcagtactaagtcgtaatttctttctaaagtttgtttaatttcagctcccatcagcgagtccataccaagatcagagagggtagcagaggcctgtgtatttttggtgcccttaagacctaatatatttgcaactgcatcaactaaactaacacctcctgcaccagcaccagcgtctgctttcctcttatcagctaataccatggaggccaagacan

SEQ ID NO: 314 - DNA, 457 bp, Ctenocephalides felis
tgnggttggcattatcancaaccccaaagacaagcangttgaaatgtctgtttcaaaaataaactgcacanngatttttagctgaccctataacacctgtaanaagatttacaanancctcnaaactccatgcgaacaaaaatggaattacttgtgctacgaatacanggggaatttgttatntgcattggaaaatgaggaaaattttgattccaaatttcngattgatacatggaataggcaanatggtaaatggggtggaattacttgtgttttacaggatggagatgtgtttgaaaaagcgggagtgaatatcacagtaatgactggtgaactanaaccccaggccattcaacaaatgaaaagtcgtggaaaacanttcatccantgaaggtggaccactanaattcnttgcggcangtgttagtgcantaantcatcccaaaaatcctcatgt

SEQ ID NO: 315 - DNA, 498 bp, Ctenocephalides felis
tggcgaaactatgggtcactctgctgatagattggctgctgctttcaaagcatctcgagaagaacaagatgcatatgctttgaaatctcatacatatgctaaaaatgcacaggagaaaggatatttcacagacattgttccatttcaagttccaggtgtgtcaaagatggtagaaactgacaatggtattcgtgtcacatcattagaaagtctggccaaattgaaacctgcctttgtgaaaccccatggcacaattacagctgctaatgcatcattcttgactgatggtgcttcagcttgcctcattatgactgaagccaaagccaaggaattaggtttgacaccaaaagcttatctaagagaatttttgtatgttgcccaagacccagtcgaccagttgctgcttgggtcctgcttatgttacaccaaagatcttagaacgtatggtctgagttaaaagacatagatgtctgggaaatgcatgaagcttttgctggt

SEQ ID NO: 316 - DNA, 465 bp, Ctenocephalides felis
cactcgtgttcttttcccatcttcattttgactgcccaacataagtataatgtctttatcccctagattgctgcttgaaacaacaactgtatgcacatgacggctatgaaaccattctgtgcatttccatgcatcgtcaatgttatgaattttgcaaccagtgagcaactccacctcaaattgatttggagtaacaatatcagccaatggaataattagttctctataaattggtaataatgattctggaacatacatttttccattatcacctaacactggatcgcaaacgtatgtcaattttggatttttttctctcaattccttaacgacgttcgcaattgttttaagaaaatctggattagctacataacccgttaataagtgactgtagacattgataccattcaatgctaacccttctgccagctctcctaattccttgtccgttagaacttgcctcgt

SEQ ID NO: 317 - DNA, 500 bp, Ctenocephalides felis
tttttttttttttttttttttttttttttttcttgaatncataataaaatttattattagntnattataaaaaaaatacttaaaaaatatattatatgcttaaatngtttcatgtagncatatatttattacatganctttttaactaaatctataangggttgaatcaattcctccgttgnagttncattgttattaacaagancaaaatcccagttttcataattatntaaatcacattcanangcaacatcatcaacaccttcngtaaatttccaacctcganattntcgaatgcatttactgcaattaattctaatngttataactttagcaccatatttttcaataaaccattttatatctgngttcctgcggatatcactaactatgcaaataggttttgaaattgcttggcaagccctttacaaaaataaccataatcttcatttcaaactcggtcgctccattctatcatactttctgagctttctttanat

SEQ ID NO: 318 - DNA, 585 bp, Ctenocephalides felis
nctgacaatttatcttaatagaatagcacaagcaacattcgacaacttttcaatggctggggtctatttcgtgcatcgaagtcgttaaaggaaaattcgcctactgccaaacatgaagaactcatggcaaaagcatggtgttttgaggcttcagaacgcctagaggcaaatttaaaacatgtagtaagcggtaagcatttagatttatataccaaattagctacaataggcaaaaattcatgcgctgccaatggagttccgcaaaataatccattaaatttgtaataaatattaagtatgtgtaactaagcttaagttcatttaatttattttattgataaatactttaatttaacagaatgtaaatatttcattttatgtaaataattagggggnatttgttatcaagatcgtgcgccaaataagccttgtcatacagattattttcaattttgataataagtaatacaatgcgcattggtacattttgnaatctgaaatattgncaatggcctgatatatttaaatataaaatgaaaaaaattaaaaattaaannnnnnnnnnnnnnnnnnnnnnnggcttgg

SEQ ID NO: 319 - DNA, 363 bp, Ctenocephalides felis
cctcctagttcacctgttttataatcatntggaaaaacatgatgataattgtgccaaccttcaccaagggctgcaattgcaacccctaagttttccactggacttatatttttgtcataaggtttctggccccacatatgtgcaacactgttcacaaaaaatgcaatatttagggtcaaacagaacctaaaattaaaattgacccaaaaagaaacccataggtcttcttgccaaaaataccaaggcgccaaaaccggtaaacctatggccaatagggcaaatagagggatgtaaaaccttttttgccacatgactactgcatcggcttccaagtcactcatatcaacctgtttccttttaagt

SEQ ID NO: 320 - DNA, 223 bp, Ctenocephalides felis
ttcatcagaagtgtttccacagtctggccaanttaagctatacccttggcagctagttgtgacgattctcctaaattaggatggactaaatgagccatgttcggtgctccaccaatgcctatgctacggaatgcacgttttgaaacttcatcgaaaatcatacccaaatttgctgcagggtttttaaatgctttttgtaattctttcaaatgtgcaccagcgt

SEQ ID NO: 321 - DNA, 337 bp, Ctenocephalides felis
ttttataagcagaaccaccaggtgaaagataaacgttccaggatcctgcattattgaaaactttcagaaaattaccagataatttattttgtatacaaaacgtgtctgtatatgcagcagcctggatggaagatggtaacttttgtattagtttggtaacttttttcttttcatctggttgaaaattggatcgttcatacacttttttgacgcgttgcacaaaagtgaaaaaatcatcgtaattattggtttgcaataaatcattcactacaaataacccatgaatgctcagtggtaagttactgttgtaactaacaaaatctatgagagaaagtgt

SEQ ID NO: 322 - DNA, 549 bp, Ctenocephalides felis
gaaccaacaaattccatctacaaccaaatttaatattaaaatttgaaatcatttttaaaaaatgatcgtcagaagtgttttgggcctttgtgtcctggttgggctcctggtgtctgcaaaagcagatttaacagatgacgtcatggctaggatgcctgatgacttcaggagggagtatttgtaccagaaaaagttgacagtggtggatctgattgagcaaaatggttacccctgtgaaacccaccaggtgacaacagaagatggctacatcctgaccgtctacagaattcctcacaacagaaacaacgacaccattaccaggggagcagtcttcgtaatgcacggactcctgtccagtgctgctgactgggtcgtcctcgggccacatcaaggactaccatatttgctttccgaccaaggctacgatgtttggctaggaaatgcaagaggcaacacactgtcaggaatcacacacattgagtgtgaagagtggtgaatctggaattagtggaacgagattgttatacgatttgctgcatgatcgatacg

SEQ ID NO: 323 - DNA, 369 bp, Ctenocephalides felis
ggatgtgatgtgtctaaaggggaaactttgtctgaatatattggtagtggaccaccacagggcacaggattacatagatacgtttttctgctctacaagcaaccggataaaataaaatttgatgaattgagactgactaacagaagtggcgataatcgtgggcagttcagtattgcaaaatttgccatgaaatataatttaggtcaacctattgctggaaatttataccaagctcaatgggatgattatgttccagaactctataaacagttgggagcttagctggctaaaatatagttcaataataatatgaacaatgtttgaattttaataaaactattatttgttgataaaaaaaaaaaaaaaaaa

SEQ ID NO: 324 - DNA, 549 bp, Ctenocephalides felis
gcatattatttatttttatatatgtatatccagctagataagttaaacatgcactcattgagtttcatcatcttttagtagtggcatttcgtcttcttccccttcttgacgaattttgatgtgggcatttttgtcagtttgtgattgcggtgcttgtgtagaaccaacactttttggtggatatggtattctgaacaattgaattcggagatgatcacatatttctaagcagacttgtgcacagtatctcatcagatcgaagatggacaaagccaaacaaaggcagagaacataatattcatttacaaagttgttgaaatactgatttaggaataataaagatggtcctaatagagcccagtctaaatattccatttcactttttgtcatatgcgcgaccactaatctgtttgtgacctttgcagctccattccaaaggcgagaatatacaaagcgggatgattctcaaatatattgctggactcttctggcaaataatgaatgcaggaatacaaccaaactgaatggattattggtacaaacctgtcc

SEQ ID NO: 325 - DNA, 549 bp, Ctenocephalides felis
gacaaatccgagaacttcgatgattacatgaaagccttaggtgtcagtctagtcacccgtaaattgggcaaccaagtgagcccagtggtagagctgactaagaatggagatacctataccttgtcatccactagcaccttcaaaaattccatcatcacattcaaacttggtgaagaatttgatgaagagactcctgatggccgaaaggtaaaatcggtagtcaccttggatggtgataaactgactcatgaacaaaagggagataagcccaccaaaatagtccgtgagtttggaccaactgaaatgaaagcagttatgactgttgatgatgtggtctgcacgagaacttacaaagcattgtaatttcaacactacggttttctatttttgccttaagttatatgcatactcgtatggaatctgttataatacagactaattgactaattatggcattgtaggatgctgcttgttcatctgntaaagtactgtttaacttttttgttttatcgaangatgaaattaancttaaaaaaaaaaaaaaaaact

SEQ ID NO: 326 - DNA, 298 bp, Ctenocephalides felis
aagctaccaccatcgcaaaatgcgataatggagctcctttgccaaccagtgttgacgtcgaaggatgtgacaaattaccttgtccattagttcgtggtagcacttctttgactgatgttaaatttactgtccctgccgattctgctactctgaaaccagaggtaaaagccaaagttgccggtgtcaccgttccttacccattacccccagagctaagtgatgcttgccaatttcttaaggaaggatcatgccctttgaaaaaagacgataaagtcacatacaatctaaaagttccagt

SEQ ID NO: 327 - DNA, 598 bp, Ctenocephalides felis
gaaatcaataagacattatgaaactaataaacagtatgaaagtaataaacaatatgaagctagtaaacaatacgaaggccataaacaatttgaacctagtcgaccttttgaagctaataaacaattcgaagctagtaaacaatttgaagctaacaaacaattcgaagctaataaacaattcgaagctaataaacaattcgaagctaataaacaattcgaagctaataaacaattcgaagctaataaacaatttgaagctagtaaacaatatgaagctaataagcaatatggagctaacaaacaatatgaagctaataaacaatatgaaagtaataaaccatatgaaaccaataaacaataccattcaatgagcgaacgtcatcatgaatttagcaaatcaggaggatatggaggctcgaatttcgatcaaaatcaggcanatgcaanaaactttganagaaacggaaaatttgaaagcagcggaagctatcaatatcacantgaacaaatggcgagaaatctactgattcaaataagccttactcctaaacatatcgatgagctaatagaaacgttatctgatagttcaatgtactcg

SEQ ID NO: 328 - DNA, 221 bp, Ctenocephalides felis
gaacaatatagataccaaaatcattttgaacgagatggaacttgcgcaagagctcacatggaatctttagttgatggtaaaataaaattcagacatgtcatggaagaaaatggaaaaaaagttgaatttagtggacaactcagacgtaatgatgaacattccggtaatggatatctgagaatcagttatgaagatacaaatcgagaatcagattatatagt

SEQ ID NO: 329 - DNA, 489 bp, Ctenocephalides felis
ttgatagacagatcagtcgcatcaattgaatcttgagctattttgctcaattgactattttgctcaattggaactgactgaatagacggaattccttcaatactttgacttccaattccatctccaagaattttctctaatttttgggtgaataaggaacttctaattgacgctgagtcagaatttttatctctgagctttacagaactagatcctgtattagttttatcagtttcgggtttataacaatcatcacattgagaattcaccagtcctgcaggatcaactatttgaatattgtcattacagtgagctttatcatcgttgtctttgaattcttcatttttgatatcgatttcatttttagtttcgggaaaatctttcagcgctccgtcacgtagtaagctagattcagtggaagatattgaactacttctaattgatttaatggatgagttattgctttttgaagagctttttcgaagttca

SEQ ID NO: 330 - DNA, 352 bp, Ctenocephalides felis
cagtttgtccaattactcggaatggccaatgcttcgaatcttgctgcactgcaggttcttcccattttctaccaattaatcgtttagcatcaaatacagtattttttggattcatagcggcctggcccctagctgcgtctccaaccaaacgttctgattcagtaaaagcaacatagcttggcgtggtgcgatttccctgatcatttgcaataatctccacttttccctgctgccatactccgacacaggagtatgtagttcccaaatctattccaatagctggcatttttttctatgttagactgtttgattgttaatcaaaattaaatccaattgaactcgaactttgcgt

SEQ ID NO: 331 - DNA, 265 bp, Ctenocephalides felis
ttttttttttttttttttttttttttttttttctgcatcagataatacctcataagcnggtcctagatcttgaaacttcgaggctgcatctggatcgtttttattcttatcaggatgcaattcctttgcttgtttcctataagctttcttaatttcatttaacgtcgcactacgagatacttttaatattgaatagaaatctcgtccagcgctggctagtaaaaaataaatacttaagttaactaacactaaataacacagtttg

SEQ ID NO: 332 - DNA, 498 bp, Ctenocephalides felis
acatagtgatcttcatcataataaccgatgtcaccagttttgaaccaaccagtttctggatccaaaacttcagaagttgcttcaggacgaccataataccctaacattgtagggccacgtagatacatctcaccttgccgatttggccctaaagtttctcctgtagaagtatccacaatcttaagttcagtgttcattaaaacgtgtccaacagttcctggtctatattctgcgcaagttatagttgtagttccacccatacattcggtcaaaccataagaaaccaccaatttaccatttgtcaaatgtttttgcatagtctcgacctgttgtggtgacaatttggaaccaacagcaaacagcaacattacatctccaaatggttctgcaagttcttccttatcttgtaaatacaaattcatcagagacaattggtaagatgatagtagcatcaggcctgcttgtattcgcgcataattctcaataagtttcttcgtt

SEQ ID NO: 333 - DNA, 500 bp, Ctenocephalides felis
tccgaagccttngccgttantntttactcatcactccagagaaggcaataaaattggcagcaaacgactntttcagacaccatttgaaggacaaaaatggtaatttaccaataacaaatcaaatggtggctggaggggttagctggattatgtcaaatagtaataactacgccaatggaattgttgaaaatacaaatgcgggatgcaggacggatagctgctcaaaataaaaaagctggaatagccactcctaagataccagctactgaattaacttttggacttattagagacaaaggtattttgggtctatataaaggaactggtgccactatgctgcgagatgtttcattttctgntgtttactttcctttgttcgctactcttaatgcactgggtccaagaaaaagtgcggattctaatgaancaagtttttggngctcctnttatctgctgcgctgttggatcaatggcggcattagttgtcaatccatttgacg

SEQ ID NO: 334 - DNA, 500 bp, Ctenocephalides felis
ctcctgcacgctttcaaatttcacactgatctattaatacagncttgaatcacatacagactcctcatatgtataatcacatataatgnttcataagccttaattgaaatggaatttaaattgaaatggtgatccatgatggaagtgatggaacggtgaaccaccgccccctctgtgattatttgcagattctggatctaaaggatcttcaccgttgtcaaactgagctcttttctcaggatcagtaagaacctctttagcagcagcaatatctataaatttattctctgctattttcttttcatcatctttgaaattatcaggatgccatttttgtgctgcttttcgataagctttaatgatctcttgctttgtagctgntctttttacacctagaaatttataataanctcttctctcacttgntttgtaaccctgagccttcaaaagcccatctttcgctctctgacatgctcatttatttccaaagctgatttata

SEQ ID NO: 335 - DNA, 500 bp, Ctenocephalides felis
naagacgttttgaaacctncntttaaaccatttgggttgggggctggggtaanttttaaggaaacccttncaaaaatgggcacctcaactggtgcaaaacgtttttggcttttnttgggnccgtggtctttagacaaacgtgccagagggcttttcacgaaaaccaaggggagggcattgtcattcctgagaagggcgcaagcaaaaagttctcaagggcagagttattgcagttggcccggcaaagaaaccaactggtgaacatgtgcccctaggaatcaaaagtggtgacatggtttgctgccgaatccgaggcccaaaagttgagctcgaagagaacaagaattccttattcaaagaatccgatatncttgccaagttggatatcgacgaataaattgccnaaaatttaccatctttcacaatttncccaacacaaactgnattcgaagctgttgcttnttatnaaagtagcaatggtttttnnttgngggtctctt

SEQ ID NO: 336 - DNA, 482 bp, Ctenocephalides felis
ttatataatacaatttattataaaattaacgntctaatngtatcccgtgtaattaattattttaataacgattttttacttttttataatatatatgtattatattccctattatataatacaatttattataaaattaactatctaatatatcccgtgtaattaattattttaataacgattttttttactttttataatatatatgtattatattccctattatataatacaatttattataaaattaactatctaatatatcccgtgtaattaattattttaataacgattttttacttttttataatatatatgtattatattgcaaaaatgtaaaaaagtaaaatttagttgcgtgaattcgtgcagttcacccgaaatgcantattgccggaaataggagcagatcccggtaaagaatnctgtagcccagacaagtggcgctgtcaaagtggatatctcagtgcccactaagaaag

SEQ ID NO: 337 - DNA, 418 bp, Ctenocephalides felis
ttgacaagcaaaataaaatacatcaacgttgttttttacggccacttgcaagttatttaatggttccattttttgaacaactccatttgttccaagaaccaatgatgtttcatatgtttgtgatggttgtaaattcggaacttgtaatggtgcaccaggtgccagaccaaagctgtttttattcaactgtatggcaaaaccactcatagcttgcattgctttgttggtgtagctcatgtccatgtaaatctgtccacttctcctggagaatgttccatatatttccaaacctttgcccttttcagctggcaaccacaatgcttttggtataacaaaagggccagctgatcccacagagaatatttctcccagaagtccagagttaccgatgttattaagtanaattgacatctgatgt

SEQ ID NO: 338 - DNA, 549 bp, Ctenocephalides felis
gtcntattccattattccatgcacacaatattcaggcgaatgagcctgctttaagcactctaatttgttcaaagtaaacgtaccggcccacctcgacactcggtgaagagcaccgtggtaggattttgagttgggccgccttttgacaggctaagcccaccggtaggacgtcccacagacatgccagttgaacaccgcgagcggtgaaccgacagtgtgggacacagattcaactacgagctttttaaccgcaacaactttaatatacgctattagagctggaattaccgcggctgctggcaccagactggccctctaatagatcctcgttaaaggatttaaagtgtactcattccgattacggggcctcggatgagtcccgtatcgttatttttcgtcactacctccccgtgccgggagtgggtaatttgcgcgcctgctgcttccttggatgtggtagccgttctcaggctccctctccggaatcgaaccctgattccccgtcccgtaacaaccatggagtcgcagaactacctcgacagtgataag

SEQ ID NO: 339 - DNA, 549 bp, Ctenocephalides felis
aatctctgaaactaattacgagtgcagtagcaattctttttttactaaaagaaaaataactttggaacaaaatggcaagcacaagaccccacagggagaacatgacagacgaacagattgcagaattccgtgaagcttttgctttgtacgacaaagacggagatggtgcgatatcagccgccgaattaggaactgtcatgagggctttgggtcaaactccttccgaagccgaacttaaaggatacgtcaaggataatagcgtggccatgaccgtagattttccaacatttttgacaatgatggctcgtcagatgcaggaaggcagcagtgttgatgaaatccgggaagccttccgggtttttgataaagatggtaatggccgaatgtctgttgcggaattgagacacattttaacatctcttggagaacgcttaacagataatgaggtggcgcaatgatccgagaagcagacgtagataatgatgggatgtagattatgagcaatttattcaagcatgcgatgagttcataatataaaaataataataa

SEQ ID NO: 340 - DNA, 549 bp, Ctenocephalides felis
gacnntataacaaaccgagattatttttgaaatnaaaggtattaggaaaaattattgataataacataaaagtctaaatgcttttataatatgacagcaatgcgtactgcaatgaatgttgtgtatacagttttgtggattctattaatttcacaaggtacccaaagcgttgaattaacttttgaactaccggataatgcaaaagaatgcttttaccaagatattcaaaaaaatacaagcgtcaccttagagtttcaggtcgtcacgggcggtcagtatgatgttgatgtaacattagaaagcccaaataagcaaattatatatagtcaagtgaaaacccaatttgattcgcatcatttcactgcaccgataagtggtgtttacgttgcttgtttcagtaatgaattttccacgttctcacacaaattggttatatggactttcaagttggtgatgaacagctttacccggtgtcggggagcatgctacagtcttacccaacttgaatctttgccaagagattcatcgaagtttgccagtttctcaatt

SEQ ID NO: 341 - DNA, 549 bp, Ctenocephalides felis
ataccaaataaagtttgtttgtgagaaaaagtatttgcataatttggattatttccactatatcagattactcatttgaaccatgtctctcgtaccattgttgtttcacgactggtgggaggattacgaccacccaatgcgtcttatggaccaacattttggaatgggcctaaatcgtaatgatcttattactaatctaagggccactccatcactcttccgtggcggttattacagaccttggaggaatgaaattactgctgacgattcttcatcaactatcgttgctgacaaagataaattccaagtgactttagacgttcaacaattcaaaccaaaagaaatcaccgtaaaaacaaaggacaattgcgtaatcgtcgaaggcaaacacgaagaaaaacaagatgaacacggatacatttcccgtcattttgttcgacgatatgtcttgccagaaatcacgatgctgccgatgtagtatcgagtttgcctcggatggagtattgccatacagcgccaagaaggccttcagtgagcagacgagtggcc

SEQ ID NO: 342 - DNA, 383 bp, Ctenocephalides felis
agcnttaaataacaatttcaaattcaatatgaggaatttagtggttttcgggttagtgttggtagttttatttgttgttacaatggcagaagacacaccagatgaaaatgagaaattcgaagtgggaatgtcagaggtttctttgaatgatgtagagccagcaccacgtgtagtatgccaacttggaggaaacagattatgcaatgctcggtgcatatctctaggaaaaagaggaggctcgtgcaaaaaaggaacttgttactgcagaaattgaagaaatttaatatagcataatatattagataaactttgaataaaaccgtgttaaaaattttgcgcaaaatatataatatacctacaaattaaaaaaaaaaaaaaaaaaa

SEQ ID NO: 343 - DNA, 549 bp, Ctenocephalides felis
aacagctgtttgtgccgtacggtggtccccgcgtgtgtagcattgtagcagtatcaaagcgaagctcgatcgatccggtcgagacgtgaagcccgcgcgatacccccgcttcagagacaatttacagactccggagttaatatcacgaaaccactttgtgttcgacttctcagtacgacagtgtcggtcatttcaaacgcgcgttgtgtgtgtccatctatcatttacaacggggttcctgatttttcgaaggttcagtaataattttcgtatttcgttatggcgatgagatgtgtaggattgctcgtcaagagcaccatggtccagtccggacagcgcaggctgatatcccaatcagctgttgctatgaacaggatgcttcaggattcaccaaacgctcacctagataaatcaatcttgcaaaggtacactcgtcttctcaagacgatcggtcacgcaggtcacttacgtgtggatcgatggacggtgagtacttgccgctaaggacgtgtcttgaattaacctccaaaccagaaactgcaaatggac

SEQ ID NO: 344 - DNA, 549 bp, Ctenocephalides felis
tatcaacttaaataccagcatcaaaatggtgtcagctggcatgacgtgcgtgaagtatttattgttctgcttcaatttaatatttgctctttcaggactaaccattcttattgttggagccctaatccaatcatcttttcaccactattctgaatttgtaaatgctagtgtctggtcagctcctgtcttgcttattgtaattggcgcaattgcgtttgttatcgcattcttcggatgctgtggtgctgtgaaggagagcaattgcatgatctatacctttgcagtatttctcattggtatatttatattggaattatctgctggaatagctggctatataaagcatggtgaacttgctgaaaccttggaaaataattttaataccagtatgaattcctatattgatgataagcaaacacgtgcaacatgggacgttatccaggaagatctcgattgctgtggtatgaatggccaagtgactggaaaaaagtttttaataatgaccaattccaaaatcctgtgtgatgagctccaaagtgatttgaatgc

SEQ ID NO: 345 - DNA, 549 bp, Ctenocephalides felis
ggcttattgacgttagtataacctcgtttctaattcatactgaatttctcaatttatcagtataattaaagatattgttcatctgctttccaggtgtacgtcttcagatctgtaagtaaaaatattttacaagccgtccgagttcattgtgttcattcgagctgtgttagcattgcacttcaattcctcaagtttcatacataattcaaaatggctcgtactaagcaaactgctcgtaagtcaaccggaggaaaagctccacgaaaacaattagccacaaaggctgcgcgtaaaagtgctccatccactggaggcgtcaagaaaccccatcgttatcgtccaggtactgtcgcccttcgtgaaatccgtcgttatcagaaatctactgaattgtgatccgtaaattacctttccaacggtggtgagagaaattnccaggatttcaagacagatttgcgttttcaatcactgctattgcgctctgcaggaagcagtgaagcttcctctagnttgttgaagacaccatttggtgccttcatgctagaggta

SEQ ID NO: 346 - DNA, 550 bp, Ctenocephalides felis
gacatcattactggtgatgagatgttctcagacacatataaaataaagttggtcgatgaagttttgtacgaagtgaccggcaaattggtttcaaggtctcaaggggatatccaaattgaaggtttcaacccatctgctgaagaggctgatgaaggaactgaaacagccacggaatctggtgttgatgtggtcttaaatcaccgcctttgtgaaacttttgccttctcagataaaaaatcatacactctttatttaaaagattatatgaaaaaattggtggcgaaattagaggagaaatcaccagaacaagttgaggtattcaaaacaaacatgaacaaagtcatgaaagaaatattaagccgttttaaagaaatgcaaatgttcactggtgaatcaatggattgtgatggcatggttgctcttatggaatatcgtgaaatagatggtgaatctgtccaattctgatgttctttaaacatggctagaagaagagaaatttgaacaatacactatttattatgtgaaactcatcttaatatactgattttgn

SEQ ID NO: 347 - DNA, 550 bp, Ctenocephalides felis
agaaaatcaacttgtgtcacggcaactgggacagtatcacctatgaaaaatgaatttggaaaagttgtttgtggtgatcctgtgtctgtgcttggttgaaagttcaatttgtgccactgtcatctcaaaagatgatcaggatttatatgagctatctatcatacatctgaatgattttcacgccagatttgaagagataacacctcaatcaacagcttgtaataataaagaagaatgtatcggtggaatagcgcgtgtctataccgaagtaaagcgtctgcaaaatgaaaggacaaatccaattttcttgaacgcaggcgacaattttcagggcactctttggtacaacatacatcgatggaatgtcacgcagtactttttaaataaatttaagactgatgctgtgacattgggtaatcatgaatttgaccataagattgaaggtgtggttccattcatgggttccatcgaagcacctatcgtagtgtgcaacattgatgactcgcaagaccacatttcagggcaaatcaaaaagacattgtttagacgc

SEQ ID NO: 348 - DNA, 550 bp, Ctenocephalides felis
ggaacgtgcaaagaaagatccccaattttatatgctttggtctgctgatgatcagcctgaacatatgcgtagaattcataaacacattgcggcgccgaaaagacacttgccaggtcatgctgaaagttacaacccacctccagaatatctatttgacaagaaagaattgaagcaatggaataaacaaaaggacacaccatggaagcgtaaactacattttgtacctgaaaaatataattcactacgcgaagtaccatcatattcaagatacattaaggaacgtttcttacgttgtcttgacctttacttatgtcccagagctataaaaatgagattgactattgaaccggaagctttggtaccacaactaccaagtcctaaagatttgcagccattccctactgtcaaagtctcgtctataagggacataaagacatgataaggtgcatgacaatagattgcttggacaatatctggctacagggtctgatgacatgcagtaaaagttgggaagtttgcaccgccgtgttgccacaatatatgtccggga

SEQ ID NO: 349 - DNA, 549 bp, Ctenocephalides felis
ggaacatttattcgtgaagctagcactagtcatgcattgtttggtaaacatattctcactgtagacatgttcaacaaagaacaattaaatgatattttcaatttggctgaaaatatcaaagctcgcgttgtcaaagatcgaccagtagatgaaattttgcgcggtaaggtaatggcttctatcttttatgaagtgagtactcgtaccagctgcagctttgctgctgcaatgcagaggctcggaggccgagtgatccatatagatgaaactagctcatctgctaagaaaggcgaaactctagaagattctgtttctgtcatggctggttactcggatgtaattgtacttcgccatccagaaccaggagcagtagctaaagtggctgcgcactgtagaaagccattaataaatgctggcgatggagttggcgaacatccaactcagcgtgcttgatatatttactattcgtgaagaaatggtccgttatggttgactatactatggncggacttgaaaatgcgtctgacctcattgntcgttggtgcgtat

SEQ ID NO: 350 - DNA, 536 bp, Ctenocephalides felis
cgattccgaagtgcaagaggcatacgaatatctgaaatcggatgaatttgccaaagcctggaagtatgctgtcgaacatccggatattttggaaattctggattatttacaggaaagcggcctggacattgtagagcttttgaacaaaattgctgactatttaggtctccagaccttggaaccaagatccatcaattacaacgatgaaattccaatttccacaggtggtctcaaggaattggtgaataaaattaaggacatgttacctttaaccgattttatgatcttattcttcgacaaaatggacaatagcgatgacttccagaatctaatgacccgcattcaatctactgattttcaaaaaattatcgattttgtagaaaactctccagaaattttggctctaattgataaattggaaaatttaggctttgatgttgacacaataatcgatttcatcaaaagcttcttcggtggcttaataaaccggatgtgatgaaataaatatagaatattcgtaaaaaaaaaaaaaaaaa

SEQ ID NO: 351 - DNA, 284 bp, Ctenocephalides felis
cctncctcctcatttaaacaatgcttgtgatcatttgaacgatggcgcccaatgccccttgaagaaaggtgaccaagttacttacaatcttaaagttccagtactgcaatcttacccttcaataaacttggacttgatggtgtcacttgtggatgacagtaatgagtcagtagtatgtttcaagatcccgtgcaaggttgtataagtagccaaaataatttttgatttgttattgatggaacaaaattaaaataataaaattgaaaaaaaaaaaaaaaaaaaaa

SEQ ID NO: 352 - DNA, 549 bp, Ctenocephalides felis
cttaagtgttcagaatgccacaatcaatgcatgtaaatggctatgccaacggccacagcggttccttcgatatggaggatggatctgttttcttgtttacttcggaatctgttggcgaaggacatccagataaaatgtgtgatcagatcagtgatgctgtattagatgctcacttgaagcaagatccaaatgctaaagttgcttgtgaaactgttactaaaactggaatggttctcctctgtggagaaataacttccaatgctgtagttgattatcaaaaagtggttcgtgacacggtgaaacacattggttatgatgattcatctaaagggtttgactggcgtacccttaatcttctggttgcattggaacagcagagtccagacattgcgggtggtgtacacatgaataggcaagaacatgacataggtgctggggatcaggtttcgactataggacctgcaatgtctacttgcattgatctcagcacctatatagcagctggagtcatgacatcgaaggatgaaaaatgggcangaaacagggtta

SEQ ID NO: 353 - DNA, 550 bp, Ctenocephalides felis
ttttacatcaggagtgtgtgcagcctgcatgttctttgtttacaataaacgtcacaatttaatcgtgtctgcagtcttcagctctgttatatcttgtggaaatgcagcgttggactgtcttatcaccgaggtgtttccaacaaatttgagggctactggtgtggcaatatctatggtagctgctcgacttggaggcataattggcaatgtggtaattgcaactttattagacatgtattgtccagccccgacatttattgtagcactactattggctggaggtggtctgatgtgtctatttttgcctaacacgaccagggaaccactttcataagaaaatctcatcgtataacagtcgggcgatataataaatatatttattcttctgctccatcccaaaaacttgattttgaatttaaatacttataaaataatgagtcttttcttataaaaatgtatataaataattatcctanagtcgttcattaattanttcattaatgatgacttcgttattaattaataactantaccnancatcnanaaaaaa

SEQ ID NO: 354 - DNA, 498 bp, Ctenocephalides felis
taatgtcgtagaaaggtgaaaaactgcgagttgtttgcacagttgtaggcaaacctacaccaacagtgtcatggaaagttattaatgagacttatgacgaatcatccgatcgaatcaaattgttagatcatgacaatataccaaattctgctttggaaattgatttggctgaaaaaagcgatcgaggagaatatacatgtattgctactaatcaaggcattggaattactgttaattctacaaccttggttcgagttcaagataaattagctgctttgtggccatttttgggtatctgtgctgaagtaataattttatgcgcgattattctcatttatgaaaagaaacgcaacaaagctgaaatggaggagagtgatacagatcaaagtncagatcgaaaaaatactcctgtcacatgaaggcactgtgtgaggcataggaagtaancaaaanttaatcngttgaataaaagttatgcccngagtgaagtatcaaagn

SEQ ID NO: 355 - DNA, 498 bp, Ctenocephalides felis
tattgttggatggatggtgactttcatcagctgctttgaggatatcgtgagcggcacttaacataactacatatccatagttgttgcataatccaaggatccagtaggccaccaggtcccgccagaggcctctgtcttttaaaggagtggattcgtgaggcgattctggatttttcgttggagtcatcattttaaaaatcaagtaaaaatcacagatgtatgcttacaggttaatttaatttatggagcagaggttctccaccaaaaatcgaagatactttaaatattgtaaacaagaccacacttcaagtctggttaaaatttaaccaatgtatgatgtcctgaatgtagatttctgctagtccaaataatgtttcaataaattgtaattcagcacaaactattctaagttcactaggcttctccaacaatctaaatccaactcattatcttcttcttaatatgcaccaagatcagtcttttggtcatttttagcta

SEQ ID NO: 356 - DNA, 269 bp, Ctenocephalides felis
gtgttgagtggtatcaaaacttggtcacccagtttatgagagaagtcttgccacaacatttccaaagcatttgtctggtgtagcaaaacatcgtgcccactccatgggctttcgtagacttcagatactgcttccattaaagacttggaagcactttgcacagctctaatacatcttatgtagttattaaattccttttgcagtctattagcactattttgctgcctggtgaagttttgtaaatgctcatcaaaaatatcatctgcggt

SEQ ID NO: 357 - DNA, 498 bp, Ctenocephalides felis
taatgtcgtagaaggtgaaaaactgcgagttgtttgcacagttgtaggcaaacctacaccaacagtgtcatggaaagttattaatgagacttatgacgaatcatccgatcgaatcaaattgttagatcatgacaatataccaaattctgctttggaaattgatttggctgaaaaaagcgatcgaggagaatatacatgtattgctactaatcaaggcattggaattactgttaattctacaaccttggttcgagttcaagataaattagctgctttgtggccatttttgggtatctgtgctgaagtaataattttatgcgcgattattctcatttatgaaaagaaacgcaacaaagctgaaatggaggagagtgatacagatcaaagtccagatcgaaaaaatactcctgatcacatgaaggacactgatgtgaggcataggaagtaaaccaaaaatttaatctagttgaataaaagttaatgcaccagagtaggaag

SEQ ID NO: 358 - DNA, 498 bp, Ctenocephalides felis
cttggcatctagttttgtaaattcagtttggctgtttattttgctgcgatatttcaatggatttttcgtatctggaggaagtgcaacaatatatgcatatttaggagaatttcataatcctaggcatcgcagcagggctattatgggagcgtcaagcatcttcggatttgcgtgtcttgcattaccgacggttgcatggttaattataaatcagaaatggtcattctatattgactttttgggatatacatacaagccctggaggttgtatatggttgcatgtggtttgccatcactgctttgttgttttgctttgtggaaattaccagaaagtcccaaatttttgatgaatcagggaagaaacgaagaagctcgtcaaattattgccaaaatgtatagaattaatactggtaaaccagaaagtgaattccccgtatcatcaatcttagatgaatatccaggagtggatggtgaaaatacaaataaaacaaagaaatc

SEQ ID NO: 359 - DNA, 749 bp, Ctenocephalides felis
ccatttgcaaggaattatcagtgtaatccaaaaacaatcctgtccgcacgcaagcaaagggttgcgatggtcctggtcctggtggcggtggtggaggtgcagctgtcgccaagcactcggataaaggcgcttgcacgcattgttggtaaagcgcgctgaagtatgtctgtccggcgcatgtaaagcgacccacgttgaaatttcctccagagagtctcacacattcaaaatatactttgcatgttttgtctgctggatctgcaaatgagccgctctgcacgcagttgtatatgggcggcggcgtaggtggttgccaaggcgctggaggatttcttaggcactccgaaagggaagcgaccacacattgctgatacgtgctgctgaagtaagtagaaccaggacaattgtaacgcgctacactgaatcctccgcctgctttcaaagcacatttgtagtatcctttgcaagtgctgtcatagggatctataaacatccctttctgcacgcatgaaaaaagaagcggcggtgctggtgtaattggccgtagtcgtagtaatcggacaattggaggangcanangtgtaattaaacattccgaatatgtagggcccacacatntttggtaaaactcacttatatccaagttncattgggcntaaaaaatgancggttttgcanagcacccttttaaaccaagnttgnacttggagtacctttgggcgggacacncttaacccaaatnttgcnga

SEQ ID NO: 360 - DNA, 450 bp, Ctenocephalides felis
agaattagaattgacacaaaatgctttagtgaangaaatgaaattaaaattgatgattattgatngattttataccaaatgaaatcaaagataaattttatgcaaatgcaaagtttgatgaagatttggacatatggacagttgcaataactaaagaaatgttgccaccaagacgaccgatatccaaaccaggacggcgcaggcctatttctgaggtctctttggttaaaagacattaccctggcttggcaggtatacgtcacagaggtgagaatattattgagtatgacttgggcatgccatttcgcaccacatttgaatacgaagccccaacagtgtccccagcgttacaatcagtattagaagatgctttacaaccagaaggagatttagaaatcacttcaccccgtcaaccgtcttcagactgcccaaatcatgaaaagacctagt

SEQ ID NO: 361 - DNA, 426 bp, Ctenocephalides felis
cttgatagaagaatttattattaatacatattatatatattgaatatagaaagcaaatctattataaaaatattaatgcacttatgtcaatagtttcatatagtattgccaggaaaagctaagtattaagtataatatatttagttattcttaaacatatgttgttgttgttttgataaagctgtgtcttaaaatgactttatatacagcaattatcttcaataatcctttccacaattttgctcggtgtgttttagtttgctcaaatctatgggtgtattgttttccacatatgtcttaatttctttcatcaattccgatgatgggttttgctcacgtgtgagaatccaagctaattccatttttcctcgtggatgaattgtgcagctccacacaatagcaaatttatcaaaatcgctttttagt

SEQ ID NO: 362 - DNA, 420 bp, Ctenocephalides felis
ctgaattccagatgtagtgaagtaaggaatctcaaatttcacttgtattgggggttttccttccgtatcttcacattccacacttggcaatccaaaatgtgctctcattaggtattctttaccacctggaaatgattttatggaccaagtaaatgcattcaaatcaggagcatatttaacacttccaattgttgttttaaacttcggggaatctgcatcagctggtacaggaatcagtatctccacattatttgcagttgaccgtcttttaaattgtgacttagctttgatcatgtattctacacggctgtgtgcgtgcctttcaattactgattcaatccatatcaagggttttacatgtgtgttaagtcgataagacattaactcaaactctccatcaggaggaataaatgatatggt

SEQ ID NO: 363 - DNA, 218 bp, Ctenocephalides felis
cctggtggtttntggtagtgggggttttggtggttctaatgggaggatttggtggaggattttggcttangggntgggaatcggganggttccattggtttcattcangtttgaacttggagcanttgnggatgggcttatttcatcattcgttgantgnggntgggcgtctttaacgtcactggtaaataaacgcctgggcccanggtcaagtctgt

SEQ ID NO: 364 - DNA, 432 bp, Ctenocephalides felis
attccaaatatcactataagagctaaatagccttccgtcaggtctccattattaacctggtcgaccacaaaataaatattgattgcaattactaaaatcgatagaaggattgcaacgactgaattaaccgctccattaacgaattctcccatgatagcagcattgctggtaaacgctatagtcggtagggtcgcaaaaggtagttgtaaggacatcactgcattcagaaggtcgttcatacccgataggtcttcgatgctattgaaaaatgccatcagaaatgttggtatgatggcaatcattcgggtgaataggatcctcttccagcgagaccattgtaggttgaggaaaccctccatggcgaattgaccagcacaagtcccagtcattgtagaactttgaccggctgncaatatttcgacagnccaaatg

SEQ ID NO: 365 - DNA, 390 bp, Ctenocephalides felis
aaatctccgccctgcaatcttccccaaaccaaccaaccgatcaaataggaagccaactccaagctgtccaagttctcccaacaaacctcggtttgcacacacacagacaccaaaacaactatgctgtaccccaacaaaccaactttggatcctttcaccatcaccaacaaatcgcacccacaaatattgggggctactactccccccacggaattctaccaatctactacgataatgggcacggattgttgaattttaatcctttgaagcctcaaaactactacgcccagtattatccttactaccagaacacgagacagtattatccttacaattttggatattattatcatcacagtttgccgaattcgcactactacaggcagcagt

SEQ ID NO: 366 - DNA, 376 bp, Ctenocephalides felis
aatacaagtgaactcctattgacttgggaaccaactgcaccagtaactnnagcaccagagctacatttgaccgaatatgtccttactgacatgtgggtaaatgaaacagttgtcaaggctgatttggatgacctgagacacggagcatttggtgggacatacagtgccttaagtttcacgattcaaataagtcgtgaaatgggttactatttaatggattactttttgccatcagtaatgatcgtgtcgtgttcctgggtaagtttttggctggcagcagaccaatcagcacccagagtcaccttaggcacaagcaccatgttgtcatttatcacattagcaagtacccaaggaaaaactttacccaaagtatcgt

SEQ ID NO: 367 - DNA, 377 bp, Ctenocephalides felis
nctccacagttccctgcattgggccccattcttacatggcgatgggacacaagaaggtctacantcntttatgatttctgataaatgggttgacatataactataaatatccaatatttcaccattgacgaccaaaccgnggaagcagccgatcaacccttgctttatagttgatttttttagatgatccgccggagctcaccgatgaacatgctttcttcaaatggccaaactgctcctctgctccaaatcaaccatcatataatctgtatttatcatgaatctgcatgatattcgttgnaatcgatccaaattttatgccattctccgccatttaatttctatttgaatttatttcaatttcttctgacttcctg

SEQ ID NO: 368 - DNA, 498 bp, Ctenocephalides felis
atatatcttacatcgaatctaataacattnaagagttattaattttcatgtcgatgnnttagaaaatgattcagtagcaacttctgaattttctttgtaatcgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgccattgccctgagttgtgtagggtacagatctactaatgccgcgtttaccactgtcacagcaattccgcaaaccagcaaccacaaatataaatatgatgctattgttaaatgttcaataaatgcacaaattattcc

SEQ ID NO: 369 - DNA, 549 bp, Ctenocephalides felis
aacaaaacggtttaattgaatctgtagtttggaaattaataaatatggacagtaacacggggattcaaataatagcttccaaagaaccaaaaccaaggcagtttgaagatgcgttggcactcacaggttttggaaaattcaattaccttcttctggtcgtgagtggatgcgtattagtatgtgttttgatggaaactcttggaatgagttttgtcgttccttcagcacaatgtgatctggaattaacaacaaaacaaaaaggaatattaagcgctatagcttttataggtattataagcagttcacatttatggggatttttagccgatacgagagggaggcggaaagtgattatgcctacacttcttcttgcatttttttgtaccttggcatctagttttgtaaattcagtttggctgttattttgctgcgatatttcaatggatttttcgtatctggaggaagtgcacaatatatgcatatttaggagaattcataatcctaggcatcgcacagggctattatggggcgtcaagcatcttcgatttg

SEQ ID NO: 370 - DNA, 498 bp, Ctenocephalides felis
cctttaagattcgatgataatatacaancggccacagtggctgattatggacaacaaccactcgctggcacatcagcagtagtcgcaggatgggaaagattcgagacaggactagacatggcaggtgatttgagaaaaatcaacgtttcaatagtcgacgagtttgattgcttcctattttacatagaagaacaagaatttacaaaatatcagctttgtgcctcctcttctaaaaaacatatgggcgcttgtaaaggtgatattgnatcaccattagccgtagatggtcttatagtcggattatattcttggtcaggaaaatgtggcgaccccgagaaaccagaagtttattcaaatttagctgaatatttcatgtggatcgaccattctataaaaatattcacctaatttaataactatatgctttgcaatcatttatttatttgacctnggncgggacacccttagccgnatttgnagatattcatcacacttggg

SEQ ID NO: 371 - DNA, 549 bp, Ctenocephalides felis
tataaattgtatatatgagcaatgaatcaatttttttaaacattttgattttcctgggccctgtagcaaacttgatatttgacaactgaaccatcaaagctatatataaatattaatcgaatttctataaatcttaaatacatattttgaattaaagatagtaaattaacaatggcagcgggggctgagcctttgtcactagctaaagatgtcaaaagagcctgcgagctccttgataaattacaaatgactggagaaataccagccacaaaaatagctgccttacaaaaagttttacaatccgatttttttactgccgttcgcgaagtttatgaacatatttatgaaacagtagatattcaaggttctgaagacataagagcatcagcaacagcaaaggctactgttgcagcttttgcagccagtgaggccatgccatccacgagttgttgaattcctaagacagatgaaggcttagggtttaatgtatgggtggaaaagaacaaaattctccatatcatatcaagaatatccagtggtgagctgtcg

SEQ ID NO: 372 - DNA, 549 bp, Ctenocephalides felis
gcttatgtttgtttttattttgacgttgctaaaattttagctttaatgtttgttttcttgtgataaattagttttattttaaaggctagcgcataataataatgatgcatctgagcgctgacatatctagtgcacttcagcaacttgagagcatcaagacagcaatagatgactcccatgatccaaaacttcagctcagtactaatgaagatttggatatgataataagcctattgcaagatccagtttttcgaagcattgttactactcaagattcactaggtgaattgaattcccaaataacacaacatccatcaatattaccaggagattttgatataactacttcaggtgatctaattctgcggtgcccccttctcttgatttatatgataatgagtacactgatgaacaaagagtaccctctgacaattaagtccaggtagccctcagaggttaggtatagcatcggtnggggcagtcangggaacattacattcatgaagggatcaatntngcaatgaggcaaccntgatggatattcccaca

SEQ ID NO: 373 - DNA, 549 bp, Ctenocephalides felis
gcaaaatatgatcaatactgtatatttaacatacacgcgcacatatgcatatatatatgtatatatatatatatatatatatatacttatatgcatataaagcaatatcaacatctatttagttttcgatattctgcaaataataatgatcttaaattacaaatagaatattacatttaacagctaagaatttgcagtttcacaaatactgccagtcaccaaatggtattcagaatatcattcaaaacaatttagccaataatgtaagatgaaatacagatgattatagaaacattcagaatttatacactataaatatgaacattaatactatgtaccacttaaaatgtgaaatctgaatacgtcatttgatgactgcgtgtaacaagaacttgttatagattataacaattataatttaatatatctttttcattttgtaaccccaaaagagcattcctcgcgtcttgcacgacttgnggggtgtggtagtgtgatgatgatcatgtagatggtgatccttatatcacggttgggtgacgagattat

SEQ ID NO: 374 - DNA, 549 bp, Ctenocephalides felis
atcaaacaaagaaaatgaaaaccagtgttgtaaaacatgaaactgaggatactataaaaagtgaacaaagcgatcaatcaattattgaaatagatgattaataatttggaaaactatttgaagacgatgtaacaatataagatttgtgacgttgaatcacatatatgtcggtaaatgatgttttcctgtttcggaaaaactcaactagtatttatttgccatcatttacaaagccgtgggaatagctaaacctaatagagtctccattccatttgtaagcaatttatacatacccacatatatatgcaaatatatatatatatatatatatatatatatatatatatatatattatttttaaatgctggaccatgtttcttctaaatntgagtttaatgtngcattctttcgatatcgaatcattagttttatgtttttataaggtgtataattatttcataagactgtcactggagaaatatgttatttattaatttaatattaattaaatatatacattacccactatgtataaatgttcataaatc

SEQ ID NO: 375 - DNA, 549 bp, Ctenocephalides felis
cttaggaattgtggcagcaagtccagccatatatagtgcatttacacattgtattcgcaaatcgtattagtgtgtaagttctgtattttttttctatatttgaattattaggaatgatcaccaacattgtgtatattcatgtcaaatatattgaaaatgttctatttagatgtgaaacttgacatgatttaatttaatttaaatatgtattttactttgttcatgataaaggcatttatatttaaaaaaatatattttactatgtgtatgtaagtatacatgtacatgcatacatacatatatatatatatatatatatatatatatatatgatggtagaggcttggatttgtaaatattttgaagagcttcgaacaaagaatccaaaggtaataaaaaaccacaaagtttgttgaaacaatttttttatttactgtcgcgtttcggaactaagtatggtcacctgcaggacattgcaagaacatcatcttaaacaagcaatatacttagtagaataaaatgctggattttataaatgacaaattgnga

SEQ ID NO: 376 - DNA, 498 bp, Ctenocephalides felis
atggaatagtgctaaccaaagcaaagataaaccaatctcgcgtcgcccacatcagtaacggcataagaatcattccactggtccacccgatggactgcatcatggcaatgtgtgctctatcttcacttctggatatttccatcgcaattatcaaagggctttgaaaaacagatgtagatgttagtgaaccaagaaaagccgctgttataaaaacaataaaccaactggaagtaaatgctgtaattagtcttccggtgacgattgtgatgagacttaagtaaaatactggtcttcttccaatcctatctcctaattgtccaaaaataaatgtgcctatgacttcgcctgcacgtccaatagcaaatgtattagttacatagagttctctatcacaaacccagtcttgatctgacggagccgttgataaatacatgttctgtcatattcataaccatgctgacaaggtattatttgactttcaatcttatttgtctcttc

SEQ ID NO: 377 - DNA, 598 bp, Ctenocephalides felis
agtaagaagtaacttaaaccgcaaacgacccagcatatcaataacattattgtgttcttggcgagcgtccagcttgtgaacaaactcatcattccaaaaacatgttcaggttcagacgaataatcttttagcatttctaatgcatcatcattcaatgttgcaccattaactttggcaattgtgcgtaaagttttttcacatttcttcatttttcctctgcttgctagccatcttggtgattcaatcatatatttgttattaattaaaaatattgcaaatggcaatgaagaaactagaacaaaatcaaaccaatttctcaaccaccacatcaaaagaggcattgtgcaaattccaaacgtccacccaattccttgtaacatagcgacgtgtgagttttcatcacttgtcgatatttccattcctatgacaagaacagtctggtatagagacatctgcgggnagtgcagtcaccacatatccaantacataccaataatatgaactagtgagaaataagttaaatatttttcctacataatcaacaccatgctgagaaaaaatactggttccttccaatacatccctaattgtcaaatac

SEQ ID NO: 378 - DNA, 498 bp, Ctenocephalides felis
cttggcatctagttttgtaaattcagtttngctgtttattttgctgcgatatttcaanggatttttcgtatctggaggaagtgcaacaatatatgcatatttaggagaatttcataatcctaggcatcgcagcagggctattatgggagcgtcaagcatcttcggatttgcgtgtcttgcattaccgacggttgcatggttaattataaatcagaaatggtcattctatattgactttttgggatatacatacaagccctggaggttgtatatggttgcatgtggtttgccatcactgctttgttgttttgctttgtggaaattaccagaaagtcccaaatttttgatgaatcagggaagaaacgaagaagctcgtcaaattattgccaaaatgtatagaattaatactggtaaaccagaaagtgaattccccgtatcatcaatcttagatgaatatccaggagtggatggtgaaaatacaaataaaacaaagaaatc

SEQ ID NO: 379 - DNA, 451 bp, Ctenocephalides felis
ttctgttcgaagtaggaaatagttcgagtgtatgcaaaataactactgcaaatactgcactcatgaataaacgaccaataagtgaaattaccattaatgtataagcataatctaaactgaaagatagaattggtatgaaacacgccgtagcagacataaataatagaaagtttatagttcggcgtccacaaaatttcagtagcggcaaaggtatgaaataacttatacactcaagcgattcactcataatgccgtatatcattttttcgacaggcaaattaatatcgtttattgccatagcatagtaaccgagagcacttgaaaaccaagtaacaaggcaaataagtaatctatgtctcatttctgtatgcttaagtatatcagttatctccacaaaactatttttaactttctgccagcaagatggttttttaccaccatctgcttgagt

SEQ ID NO: 380 - DNA, 401 bp, Ctenocephalides felis
agtccactcaataaagtagcgacacctcccatcgtcagtgttatgttattaatccataaaacatttacgctagtatttgaagccaaaaccccgcatatcaccctagtcaatgtgttagatataccaatagttgataacaaccaagctgtttcatcatcggtcattccgctggttttgtttctctgagcaatatataggaatggtattaagtaacccatcatagtaaagaaaccactgaaggcgagcaaaaggaatgacggcgaacgcatcaagttcatatctaacatggtagcgagagttcgacggaacgcttctgggcaaagcttgcaagaagactgttcttcgacatccgcccgagtaggtaatctagttacggacatgtggtatccaatagaagtcgt

SEQ ID NO: 381 - DNA, 498 bp, Ctenocephalides felis
ggccctggacaagatgcccttcgactcaccaccgaatatggagctgtctacgatcaaaatgccaccattgaagttcttaataaacagaagaggaaaactttgtgccacactgatggcgaaggagttgaatgcgaaacagaagaagggagcatcgcacctcaaataatactatttgttgcccaattaatttctggagtcggtggatctttatactacactttaggtgtatcctatatggacgataacaccaaaaaatctaaaacaccagcactgatgagtttttcttattttcttcgtatgctcggacctgcaaccggttatgccttggctagcgtctgtctaaagttctacatttcgccaacgttgacgccaacaattgataataatgatcctagatggttaggagcatggtggttaggttggttgatactaggatcaactttaatattttttgcaacgttgattggattgtttcctaaaatctgccaagagctgcaa

SEQ ID NO: 382 - DNA, 461 bp, Ctenocephalides felis
atgaatccaattcggcaaggagcaatcacttcatcatttgaatgcccatcgtgatgctgggtcttccatacagaattcacagttgtatttttaccctcaggacaaccttcagtcgacatatttaggtaagggaatttcaaattcccttgagcaatgttaatttgggctccacttaccatccaactgaccaggattagacttgcagctgctcccaccaaaactcccttagtgtttgctttagggaacaagattcccaatgtaaacattcccaaaagtgttcctgcagttacaccagtaacactgatgacaaggtgcatgacgcttcctaattgttctactacgaagacaagccccagacaaattcctccaattactactacagtcaacttcataatattactggcagtcttctcagtagtgctaaccggtaaccactccttaataaaatcttcataaagtgt

SEQ ID NO: 383 - DNA, 498 bp, Ctenocephalides felis
aataaatataattttattatataagaaacatatgtataacaatacaaattataactatttaacagtcttcttgtgataatttcttgacggccgtatctgtagactttgatacaccttttttcggtaagctccagaacacctgatccctgccgaatacgtgagcttcagttagcgtttccggtaacttttggtgtaaagtttccggcaagaacattccggaagtcgcgcccaccatcatcattacggaaagtacagcgtacggatatctggcgtcatatgtggttcccaagtatacaatgtatgggcctaatactcctaatgcatttgaaactatagttccaatggaaattcctgtctgcctcaaacaggttggatatgttttcattgcttgcagattcacaacataaaacgtgatgcttatgcaaaatttcattaccacggctaacagtgggaccaaattctggagggattcatcattggcaatgcatataagaatgg

SEQ ID NO: 384 - DNA, 500 bp, Ctenocephalides felis
atcnnncnnnatangtggatncnaagaatnctangnatgggcctaanactnctaatgcatttgaaactatnnnnccaatggaaattcctgtctacctcaaactggttggatatgtttccattgcttgcagattcacaacataaaacgtaatgcttatgcaaaatttcattaccacggctaacagtgataccaaattctggagggattcatcattggcaatgcatataagaatggaagatgctgccagagcaattccaaaagaagctacagaggtccaacgtcttcctattctgtcgctggagaaacgtcctagtagatatgctggtaattctactgccgattgatataaaaagttgagaaatggattacctcccatattgctcacgttcaaaattaatgtaaaatacgtcacggaacatacaatccagcaaagcacaataagtgtagtatttctagctaaacgtaaactagaaaataaactcatgattccgtaaactttt

SEQ ID NO: 385 - DNA, 498 bp, Ctenocephalides felis
cattaaagaagtatctttaggaccaacaagtttagctgctctgatggttttggaatattgtcatgaaaaaccagtcgaatatgtagttttactaggctttttagctggttgcattgaacttatgatgggattactgaaacttggatttttagtcgatttcataagtgccccaatcgtatcgggttttacatccgcgatgtcgttaataattatttgtgcgcaggcaaaaggtttgctagggctgcattatacaggacatggatttgtggatacattgatgcagctaatacaaaggatatcaaatgcgagattagctgattctatacttgccttatgctgtatagtttttcttttaacattaaggcaaataaaagatttgaaagtctccagtcctgttttaaaaagaaccttatggtttatttcaactggaagaaatgccttgatcggtttaattacagcgttgcggcttacttttgggaaangaattcttggnaagcc

SEQ ID NO: 386 - DNA, 498 bp, Ctenocephalides felis
aatatttttaattcataatatgtatatgattgaatcgccaagatggttggnggagtcgatgtaaaatagaacgatgtgaaaatacattaaaaatcatttccagcgtanataagacaactcttaatgaagatgcaattagagtgttaagagaaaaatcctcaggaaaaccagaaaaagtttacggaatcatgagtttattttctagtttacgtttagctagaaatactacacttattgtgctttgctggattgtatgttccgtgacgtattttacattaattttgaacgtgagcaatatgggaggtaatccatttctcaactttttatatcaatcggcagtagaattaccagcatatctactaggacgtttctccagcgacagaataggaagacgttggacctctgtagcttcttttggaattgctctggcagcatcttcattcttatatgcattgccaatgatgaatccctccagaatttggtcccactgtagccgcg

SEQ ID NO: 387 - DNA, 396 bp, Ctenocephalides felis
atggattcatgtgcctttacctttagtatttgccgaatatttttcacaggagagatttccttcagcatacggactgttcatgttcttgcaaggaataatgacattggctttgggtccaattgttggatttattcgagatgcaacacacagctacataatatgtttccatgccttgactgtgtgtttactcatttgctgtataccatggcttgccgagatggcgtggttaaaaatgaaaaataagaaataaatttaagaattaagttaatattaatggaaaaattatatatagtttatgtgaattttatcacacgtgttatatatctttataaaagtaatttataaaggattgtcacagaaaatataaatgacaaaaaaaatgttttnnaaaaaaaa

SEQ ID NO: 388 - DNA, 203 bp, Ctenocephalides felis
agagaacattcggaagtgaagatgcctgtgaacaagcatgatggataccaaatggacttggacagtattttgaaagagttgggacattttggaaaatttcaacttctgaattgcctgtttatttgcattacaatattgctatttgctatgtatgcgatgagctatgtgttcacagcgggagtagttaatcatagatgtttagt

SEQ ID NO: 389 - DNA, 549 bp, Ctenocephalides felis
gtcnntcggtcagtcggtcttgactcgccgtacaagatagtgattcgttttagtgcgggtgtttttgttgttgaacttatgtgccttttacttaaacttttcaaatttattcaatttcatcaagtttttgatttcgactgtgacgtacctttaacaaatactaaaaatttgaaaagataaaaaattgaaatcgaacaaaataaattaaagtacaaaaaatggagaaagatatggaaaataatgaggaccaaaaagagatcaaaatggaatccggcgaagaaagcatgcgaccagttttaaacacacctgatccagtcgcgactgccacagtaatagttcctcctgatggaggatggggctgggtcatagtagccgcatcattcatgagcaacatgatagtggacggtattgtgttctgatcggaccaataattgaagagatcaaatttcatttggtgcaagtaagctaaagtagcccttatcagttcgctgtctccggattctatctgatggtggtcttttgtagtggcttgcgaatcgantgggttcc

SEQ ID NO: 390 - DNA, 549 bp, Ctenocephalides felis
gcctgtggtaggtcccaggagcaaggagtggaaatgttgcttctgtctccacgttcggactgcaacaatatgtcttggcatttggcatttgatgctgcacttggttgcactatgtgttcttgtgataattttgcattctccgaacctgataaaccaattggagcacccagatcaatcaatgatgggtgtaggtgttggttctatttctcgttataacggagacaatagcttgttaaacaaggttgatgataatggaacacctttgggagaaatggagcatcctccatatgcatatagagaccactcacttacatatcatgatgtggacatgggtgctctggttacaatttgtacactggccataacattaatgatgttatatggagcagttaaacaaaagcctgcacatattttgccattcttctgcttgcaactatttgattttgcataactacacttactgcacaggatatttggttatttgcgcagtgtcatagattgtatcagaaagtcgcattaccaatgagagaagacttttgaactaaccca

SEQ ID NO: 391 - DNA, 304 bp, Ctenocephalides felis
cattgtggatgaggcaaatcccatataccatgatgaagtttgcttgtttcgaaagaacagttgaattgttatacactcatgtggttcccaaacccagagcagaatgcactaaaggtgaacaattggttgtcacctttgctgctggttacattgccggtgtattctgtgcagtagtttctcatcctgcagacacagttgtttccaagctaaatcaagacaaaggagcaacagccattgacgctgcaaaaaacttggctttgctggtttatggaagggattaggacctaggatcatcatgattggt

SEQ ID NO: 392 - DNA, 229 bp, Ctenocephalides felis
cgtggttttggagtatctgttcaaggtatcatcatctaccgtgcagcatactttggattctatgacaccgctcgtggaatgttgccagaccccaagaacaccccattagttatcagctgggccattgcacaagccgtcacaactgttgctggtattgtgtcatatccattcgacactgtccgtaggcgtatgatgatgcagtctggacgtgcaaagtctgaaatgttgt

SEQ ID NO: 393 - DNA, 408 bp, Ctenocephalides felis
gaaaaatggcaactgctgtttgttgcataggacaaggcattttcatggcaggtttagcattctctggtaatgatcacatcgcggctattgtgttcatgactctggcgactgcagttaatggagccgtttcaactgggccattagccagctttgtggatttgagtcccaattatgccagtattacgctgggattgagtggtatgatttctgtaatgcctggttttatttcgcctgctatcgttggtatactaacatttgaaaaccaaacgatagagcaatggcagaaagttttcctcctagcgacagcaatgttggtcgtttgtggtcttttatatttggtgtttgcggactctaatctacaatcctggaacagtccagataaaatcgttcaagatccgaagaaattgt

SEQ ID NO: 394 - DNA, 129 bp, Ctenocephalides felis
aagcaagttttcttgggtggagttgacaagaagacccaattctggcgttacttcgcaggaaacttggcatctggtggtgctgctggagccacatcattgtgcttcgtctacccacttgatttcgcccgt

SEQ ID NO: 395 - DNA, 427 bp, Ctenocephalides felis
catgattggccgctgatgtaggtaaaggcgctggtcaacgtgaattctctggattgggcaactgcttgaccaaaatcttcaagtctgatggtctccctggattgtaccgtggttttggagtatctgttcaaggtatcatcatctaccgtgcagcatactttggattctatgacaccgctcgtggaatgttgccagaccccaagaacaccccattagttatcagctgggccattgcacaagccgtcacaactgttgctggtattgtgtcatatccattcgacactgtccgtaggcgtatgatgatgcagtctggacgtgcaaagtctgaaatgttgtacaagggaacactgcactgctgggccaccattgccaagacagaatgaagtggtgccttcttcaagggagctttctccaatatcctccgtgg

SEQ ID NO: 396 - DNA, 498 bp, Ctenocephalides felis
atccaagaaactttaaaatgcacatctagggaaactgatttaccaccaacaccatggtgggcaatttggacatctgttccattgtgggcacttatttgcgcccagattggacacgattggggtttcttcacaatggtaacagatcttccaaaatacatgaacgatattttgaagttcaacatttctgaaaatggattatattctgctcttccatatgtcgtcatgtggatcgtgtcgattttatcagcaatttggtgcgatcatatgttgaagaaaaagatgttgagtgtcaccaatgccaggaaattattcacaacgatagcatctgttggtccagcttgttttattattggagcatcatttgctggttgtgataaaactcttgttgttgccttgttcaccattggaatgggtttcatgggaactttctacgccggtatgaaaattaacgcattagatttaagtccaaattatgccggtcattgatggccattgcaa

SEQ ID NO: 397 - DNA, 305 bp, Ctenocephalides felis
caatcatgatgatcctaggtcctaatcccttccataaaccagcaaagccaagttttttggcagcgtcaatggctgttgctcctttgtcttgatttagcttggaaacaactgtgtctgcaggatgagaaactactgcacagaatacaccggcaatgtaaccagcagcaaaggtgacaaccaattgttcacctttagtgcattctgctctgggtttgggaaccacatgagtgtataacaattcaactgttctttcgaaacaagcaaacttcatcatggtatatgggatttgcctcatccacaatggt

SEQ ID NO: 398 - DNA, 342 bp, Ctenocephalides felis
aatactttgaatacttcataaagaccgaatttgcaaagaccctgcatggagtatccaacaaaggttggagcccaacctttagcaagacctctagcaccatcttccgctagagttactttgaatccattgaatactgatttgtattttgcaggatctacttgaatacggcatttcactaaatcaagtggaacgaccatggtgtgtgttacaccgcaagaaataattcctccaaatccgcaaagagcaaagtaatgaccagatccaaaggcacaggaatctcctgttgcatctgaggtggaggctgccattgttgccaatgatttagattcagcttcacattgt

SEQ ID NO: 399 - DNA, 500 bp, Ctenocephalides felis
tttttttttttttttttttttttttttttattattgaaattcatttattgaatataattaaaatttcacatatttatattcataattttactacatttctaagccttcattataatacccgttgcctgcagctccactagttttacttgcattagaattaatattgtttggataatcgtcatttttaatacttgtatttgtattagttaaatttttggcccatggctgcacttcgccggatgcaaaaaaccaatatatcacagctcctaacaaatatattccacttgaaatgtaaaatacaatttgccacgatgtgagtaaatcatctccaacctttccattaacaatgaaaccagtcaattgagggctgattattcctggcaatgttgcaaaagtatttgacaatcccatcagaacgctagcatattgtggtgcgatgtccaaatgatttacactgaatccagaccaagcaaaagcgcccaaacccacagcgactgcag

SEQ ID NO: 400 - DNA, 383 bp, Ctenocephalides felis
cgctgcccaatggtttatttatgatgccgtcaaagtctggttgcgtatgccacgaccaccaccaccagagatgccagaatctctcaagaagaaattagctgcccaacagtaaaaatagatctgtgatgatcctctcaataatgcatgtatcagcaatattacaattgaaattgcaactaacatctaaaatagcagtatcagtgatggactattcaatttagtaacaatgctgtctaactggatcacgtttttcattccaaattttaattttaaatgaaataggcaattataatagtattacaatttcttttaacaaatttgtgaaaaacgtttctggttgatgtgtaaataaaacaaaaaaaaaaaaaaaaaaaaaaaaaaaa

SEQ ID NO: 401 - DNA, 188 bp, Ctenocephalides felis
taagcccttatagaatccattaagtccttcatncttatagattttgggaactgcttcacgcatggtgttagcaaatccaggcatagtctggatacgaactttagcagcttccatgggagctaaagcaatgtcagcaaagaattctgcactagcagaagccgacaagtaaagcgatgtcctccataagt

SEQ ID NO: 402 - DNA, 500 bp, Ctenocephalides felis
ttttttttttttttttttttttttttttttggttatataaaaatatttgtactatagntagttctaaatatacatttgttcacaataatataaatattatataatcatttgtaaaaaaaattaatataaaaatctatacaaatatttatgttataaattactataacaacngttacaatgaaagaaaaaaatagcactactatacacaaagtctttggttatatgaaaaatatttaaattcaatctaattaattttttgcttttgcatgatgtaagattttaccatgccttttatatcagtgaatataaaagtgcctataaatacaagtgcagtaccgatccaatgtatgattgtaaattcattattaaaatatacaatagagaacaatnatgacacaaattttctaagtgtaataactaaggncactgttaatgatgaacattctgtagtcagcncatcnctgggcttttgcccnggtttngggttattncntttcccg

SEQ ID NO: 403 - DNA, 487 bp, Ctenocephalides felis
attattacttttataaaaatataaatctatggatatctatataagggagaggtgtggnnaacctacatgattaaagtatcacttttatttaattaattagctattatgtataggtaattctatttagttttgtttaattaattaattactcagccttgcttattattatcgatttcgatacggaaagccaaatcctgcatcgagtcgtgctttagaagggacttcttttcgggatctttaacttttctgattggttttttgtttttaccatatctatttgtaacaccatcatcctcgtccatcatccttaaaatagttaattgatccgatgaatctaagggggccacagaaatatcacgaacggctctgaatttaccacaattattcaaatgttcgttttccaaacggaagaaattccatacaaacctcctaaacacttccaatggtgacagtatagatgtaagaatgtccccgctcacaaaattgt

SEQ ID NO: 404 - DNA, 343 bp, Ctenocephalides felis
tttttatgctgatttagggttaattaaattagcagaagacatagagtttagtgataaggtgcaagctgtaaacattcaccaaagtgaaatccaaggtggtgaggaatgcaaagcaactggatggggtcgattgggtgccagtcaaccaataccaaatgcgttgcaacagttggcaaccactgctttaagtaatgagaagtgtaaagaagttactggattcttcgagcccacatcgcaaatatgtgtattcaaaggatctggaaaaggagtttgttttggcgattctggtggacctttagtttacaatggagaacaagttggagttgcatcatttatattgggt

SEQ ID NO: 405 - DNA, 387 bp, Ctenocephalides felis
ntgtcaacnatttgcaantatttggnaatttggcnaccattanataattacccccancnacccanantgganacggcccnaattggggtaccanaccttgccanacnancnggtttgncananttngtgtanacaanatttgangtantttttaccaaaccnatntnatngtggnangtgtncgggttaaattggttatnaacnatnatttgggcaactttgtanccaacnccgccancatncaaantgttggtnccaacnacaanaagaatancatttgganatttatttaanacccaattaccaccattaanaanccaacnattgcngatnatggaaccaccacanaattgtccttggttggttctcaaagacaccataaaaggt

SEQ ID NO: 406 - DNA, 127 bp, Ctenocephalides felis
aagagggccaccggagtctccagagcaagcgctaactccaccagtcaagggtccagtgcacaagtttgttgggtgcaatggagtagatccggctcctcctagagccttttcacactcggggtatggt

SEQ ID NO: 407 - DNA, 415 bp, Ctenocephalides felis
cgaagggaacaactttgagtgtaactggatggggcgccacgaaggaatgggggccaatttcgccaaagttacaagaagttaaagttaaagcttactcaagtcaagaatgcaagaacagtcatgctattaacagtgacatcatttctgacagtatgatgtgcgctggttttcctcaaggacaaaaagatacttgtcatggggatagcggtgggccacttgtagatgaaaaacaggttcaagtaggagttatatcctggaggcgaggatgcgcgcgacctggatatcctggcgtatatacaaaattgagccacccggaaatccaacagtttattaaaaacaatgtaaaattttaaatcataaaactgtatgaataaacaattacgaaaaaaaaaaaaaannnaaaaaaaaaaaaaaa

SEQ ID NO: 408 - DNA, 445 bp, Ctenocephalides felis
cccaggatacaatccctataagtttcctgtttttgtcaactaatggaccaccataatcaccgtgacaaaaaccgccaccttttgcagaaccagcacataacattctatcagtgattctgtctggttttcctggttctgcataattactttgacatactgaagaatctatcanaggaatccaagcaccaagtaattctgaagaatcgtttccttcggtctggttagctccccatcctgttacataaactaaagatcctacaggagtctcatattgctcattagctaaatttacaggtcgactattacacactgtaagtttaataggatttttaactttaaccagagcgacatcataatcaaaggtccttatattaaatttcggatgtaaaactatgtcggttacctcgtatacatttccatttgaattgtggtaggaacttcctgt

SEQ ID NO: 409 - DNA, 445 bp, Ctenocephalides felis
aggaagttcctaccacaattcaaatggaaatgtatacgaagtaaccgacatagttttacatccgaaatttaatataaggacctttgactatgatgtcgctctggttaaagttaaaaatcctattaaacttacagtgtgtaatagtcgacctgtaaatttagctaatgagcaatatgagactcctgtaggatctttagtttatgtaacaggatggggagctaaccagaccgaaggaaacgattcttcagaattacttggtgcttggattcctctgatagattcttcagcatgtcaaagtaattatgcagaaccaggaaaaccagacagaatcactgatagaatgttatgtgctggttctgcaaaaggtgacggtttttgtcacggtgattatggtggtccattagttgacaaaaacaggaaacttatanggattgtatcctggggt

SEQ ID NO: 410 - DNA, 352 bp, Ctenocephalides felis
gacaatctaataagggccacatcatgttcgaaagatgtaaagttggtgtcaaagtcgggatgtaataaataaaaattggcatccacaattataccagcgtaataagccctaaagctgccaactcgaacttgaacttgtttttcgttgcggacatttttgaagcattgagcaacagtgagcacaaaatatctactaactatgactcctccacaaatatgatcacctctatataaaacagatgccacgtaaggtaattcgctgatgtcagcaggctttcctccgatcatacgagaatcggtcaaatttttgctttctgctccagaaaataatacaataaagaaaattgcaaagt

SEQ ID NO: 411 - DNA, 498 bp, Ctenocephalides felis
tggtatagaataaaatttttttataatcagaaattatcttcgctttaacttttgatgcatattattttatgagatatatttataataaatattttattcagaattgttcaataaaacattgtccgtgtttttgtgaatccagtccaagaagtgatatactcttgcatagacgtctggcactcctgtgccacatggaataccaaaagatactactctggcaacaactggtccatcaggttctcgaacgatcagaggaccaccggaatcacccatgcatacaccaatgcccagtttccggaaagcacacagcattgtttcagttatatcattttgtctagaaactttattcttgattggtccttgattgagaaatttttggcaaatgcgactttcgtatgagatacccatcattttttgtaaatgatctggtatttgaccaaatggagtagtttgtccccaaccagaaacttcaacagtctctccgccatggtatcttct

SEQ ID NO: 412 - DNA, 386 bp, Ctenocephalides felis
cttttatggtgtctttgagaaccaaccaaggacacttctgtggtggttccatcatcagcaatcgttggattcttactgctgctacttgcgtgttaaataaatatccaaatgatattcttctcgtcgttggaaccaacactttgaatgctggcggagtaggatacaaagttgcccaaataatcgttcataaccaatttaaccagaacacataccacaataacatcgctttgctaaaaactacatcaaatattgtatacacaaactatgtcaaaccagttggtctggcaagctatgatacaccaattggagcagtatccactctggctggatggggctacttatctaatggtggcaaattcccaactacttgcaaatcgttgacacgt

SEQ ID NO: 413 - DNA, 348 bp, Ctenocephalides felis
ctcatctacggtcaatggacctccagaatctccactgcattgtgctctgtcataatctggataagctgcgcaaatttgctctttataaatgggtctaaagtgcaaatcaccacattccttggatccgacgatctggtagtgcaattcttgcagatgtgtttgcaaaactccgtcggtagtagaatttattccccatccgacaagagtagctggtgcattgtgtttagtttgttcatttgcttctggcaaagtaactggttgcgcaaatttactatattttaagggttcagatagcttgagaagtgcaatgtcgttgatataactgttactaggattatatcctttgtg

SEQ ID NO: 414 - DNA, 147 bp, Ctenocephalides felis
cattgccatctaatgagtttgatcccatatagacggattttaaaatgccgggttttaggcaatgtgcagccgtcacaatccaacgtttgttcaagatggatccaccacagaaatgctctaggtctcgatttctcaatgaaacttggt

SEQ ID NO: 415 - DNA, 467 bp, Ctenocephalides felis
ctttacatattgcagttgttcggggtcgtcttcatcttcccctaaatttccccagccagtaacagtggntaattctcctgatggcatgtcttttccaacatcagtaagtttgactgttctaacagntctgttattcaaccggaatggtcttcgaaccttgatgagggcgacatccatatcgatgtcagttacattaccgtatgcaggatgcttgataatttgtgccacaggatgaacggaaccacgtcttccttggaaactggtgccgactcgaactgaatacgtgaattcatcatatatgcaatgagctgctgtgacaatccaataattattcaatattgaagctccacagaaatgttcgttaaatacttggagtgaagcttgatagccatatttggcaatatcagcatcttgnctccaacaatgcgcccatctaatccatcctttatcttgnaagatgagacggc

SEQ ID NO: 416 - DNA, 346 bp, Ctenocephalides felis
tcattacggtgtggaatggctcgtccctcatcctcgttatgatagccgcgatcaaaattacaatgtaggtttaattatgataacaaaggatttcaatgaaactagaagaagccgacctgccaagctcgtagaggcaaatgtcgacttgcctgtaggctcctttgtcacagctactggatggggatctgaaacgataccaggagcacctatgtcagaaaatcttagagcaatatctttgcacgtcattgataatcaagaatgtcttgaaaaaaatcaagagttgattgatgtcacagacaaaatgttttgtgctggatcaatagaagataaaggaaaatcagtttgt

SEQ ID NO: 417 - DNA, 312 bp, Ctenocephalides felis
aattcttggctataagttcgttgcatgttttgcaagtgatttgnttattgcatttattnccgtggcatattttacatgaatcagagtttgcattacaatcgttaccctgatctgatttgcatcctcgagtaatgacacctttttcaatttttgaatagcagtcgcctttggattcatacaaactttggtcttcgtctttcctgcatctttgaaacattcgtttcttagttctggaagtttttgaacgttacaacccgatttctcgcaacacattttttctcggntagtcgagtcacaactttctttaaccgt

SEQ ID NO: 418 - DNA, 315 bp, Ctenocephalides felis
aattcttggctataagttcgntgcatgttttgcaagtgatttgnttattgcatttattcccgngggatattttacatgaatcaagagtttgcattacaatcgttaccctgatctgatttgcatcctcgagtaatgacacctttttcaatttttgaatagcaagtcgcctttggattcatacaaactttggncttcgtctttcctgcatctttgaaacattcgtttcttagttctggaaggttttgaacgttacaacccgatttctcgcaacacattttttcttgggtaggtcgagtcacaactttntttaaccgn

SEQ ID NO: 419 - DNA, 387 bp, Ctenocephalides felis
aaactggnntatccctggtgtcaatgggagctggnggnaatactgncacanaaanagcngcgggnttacgtcagcctnaancaaaagaaaaaatncaagatgactaccatgcattgatgaacactctnaatacacaaaaaggngaaactcnggaaattgccaacaaagtttacgttatggaaggctatacattgaaacccaccttcaaagaagnngccaccaacaaatncttagctggagcagaaaacttgaactttgcccaaaatgctgaaagcgctaaagttatcaacacttgggntgaagaaaaaactcatgacaaaattcatgagtngatcaaagccggtgatctagaccaggattcaagaanggntcttgtcaatgcattgn

SEQ ID NO: 420 - DNA, 236 bp, Ctenocephalides felis
aatatattttttgacatcatagtaacgacctcctttgtttagtttgttggatccgacgtagatggaactcaaacggcctgcgactagacaatgtgcagcagtaagaacccatttttcattaagaatcgatccaccacaaaaatgtttcaagaatttatctnttaaagatacttgaaatggagcagaaccgggggcggcggtctgcnnctccacaattctggtgtggtcattggaag

SEQ ID NO: 421 - DNA, 447 bp, Ctenocephalides felis
tnnnttttttttttttttttttttttgatnattagngatatttatttgagtagtaatatggtttaatttgttagttgagtatcaaaattttgtaaaacatctcgtcttagttagtctcgtcttagtcattgaaattaaggaatatcaaaaaatatttgtaatattataagttaaaactcttatattccagtgtgcattttgataaattctcttattggttttgaagccactcgggtatatactcctgggatttcgggtcgtgcacatcctattccccaagacactattccatgcagaactcccttagagttgacgagtgggccaccgctatctccttggcaagagtccttaccgccttcaggataaccagcacaaatcatattttgggtaattattagtccttcatttccatatatagttttgcactgagtccagttaacaataggt

SEQ ID NO: 422 - DNA, 367 bp, Ctenocephalides felis
tttntttttnttttttttttcttttttagggantttttatatttattttatgaacngctctgatttttaaattttaacatgtttactgataaaatctctaacaattggtgatgaaattngtgtgtatactccgggactgaccgcccttgcacacccgtcgccccaagatacgatccccacaagagtnttattttnntngacaagtgagcccgcgntgtttncttggcacgaatccttttnttcgtcaagaaatccagcncaaagcatgtgttntgtcaatgtataacgagcagcatacaatattttacagaaagaaaagtcaatcactggtatagaaacnccgcgaaggttttccgaaaaaacttgt

SEQ ID NO: 423 - DNA, 432 bp, Ctenocephalides felis
cagatgtatatgcaagagtatactattatttggattggatccatcaacatactgataatgnntctattgaacaactcagaataaattaattgaaaaaatagctaagttatcatagtaaagatcttgacgtntttataagatttaataaataaaaaacaatcatagataaaaaatcatagatagataaaccatagaatgctgttcctttgtatggcaaactgacaaattgattttaatcactaccaaattattttttgtaactatgataaaatattctataaaactattcctactaatttatgttatagatgaggtgatagtataggtcagtcagcatatgtgatatttaccagtatatttaagttgaaaccattaaattcagtattacgtgaaataaatgcaaaaaaaaaaaaaaaaaaaaaaaaaaaaaaa

SEQ ID NO: 424 - DNA, 354 bp, Ctenocephalides felis
tacctcatctacggtcaatgggaccctccagaatctccactgcattgtgctctgtcataatctggataagctgcgcaaatttgctctttataaatgggtctaaagtgcaaatcaccacattccttggatccgacgatctggtagtgcaattcttggagatgtgtttgtaaaactccgtcggtagtagaatttattccccatccgacaagagtagctgatgcattgtgtttagtttgttcattggcttctggcaaagtaactggttgcgcaaatttactatattttaagggttcagatagcttgagaagtgcaatgtcgttgatataactgttactaggattataacctttgtgt

SEQ ID NO: 425 - DNA, 498 bp, Ctenocephalides felis
atacatatccaaaattcaacaagnctatgccatactggatcataaaaaattccnggggnccccgctggggcgaacaaggatattaccgagtataccgnggtgatggaacttgcggagtggaccaaatggctacttcagcggttttggataaaccagttgttaactagacaaaaatacaccaagtgccaaatatgatcctgccaaacctttccatgtttataagtagtgccaaacaaattatcttcggcgactgaaatattggacaacttgcatgcatttttgactattttaaattgaacagttcagcattatttatgtctggcagaataacagaggcaaaacaaacaaatgncgatcaaatattacaattcgatgngctcttaatttgcataaatatagatattatactaattcaaaaagcaatctgctttaaaatgagaatataaaggagcaagncgtcagttttcttttacatggtaaaatatcgacaacataaga

SEQ ID NO: 426 - DNA, 500 bp, Ctenocephalides felis
ccagtagtattagtagatttagccgaaagtggaactgaagttaaacctggagcaatacttagtgtcactggatggggtgcaactaaggaaggtggcggnggaactttgcaactacaaggtgtgaaagttccagctatctctcccaaagattgtgctaaggggtatccaccttctggaggtaaagacaaaattacagacagnatgttatgtgctggtcttnctgaaggaggtaaagatttctgccaaggcgacagtggcggtccactggtagatgaaaatagaaagcaagtaggagtggtttcttggggtcaaggatgtgccagaccaggaaaaccaggaatttatgctaaagtgtcacaccccgaaatcagaaaatttattgaaaaatatgctaatgtttaagtggattttatttcaatataatgtgatttaagatactctttaatggtatgtaataaattgngataaattaaataataaaaattggagaactggaaaaa

SEQ ID NO: 427 - DNA, 360 bp, Ctenocephalides felis
aaaatcgaatcgttggtggcaatgatgtaagtttttcaaaaaatgggtggcangtatcagtgnaaagtaataaccaacatttctgtggtggttcaatcattgctaaagattgggtgctgacttcttctcaatgcgtcgtggacaaacaaagtccaccgaaggatttaactgttcgtgttggaactagcactcacaatgatggaggaaaagtgtatgatgttattgaaattataaaacatccgaaatataataaagcagtgccagatgattttgatgttgcacttttacggatcaaagagccaatatcatttactccatgcacagtaactcctgtaaaattaatacaatcgggaaaagaag

SEQ ID NO: 428 - DNA, 266 bp, Ctenocephalides felis
ttttctacatccttgtcaacttcttgaatctttttatccaacattttctcaatctttgtaagatcgtcttcatcataagcgtctccgcaaatcttacgagctacaacattccattcctctattacatcatcttgtgggtagaactcagaaagatcagatgagtaaggctctggttcacctggactgatgttattgtctcccatatatgtgattaaatcacggaagtcgacatcacattgaattggattttgtgaaaaatcaatagt

SEQ ID NO: 429 - DNA, 328 bp, Ctenocephalides felis
caacacaactctgcacatatattgcantttggaaaaggtgcatgtgctggtgattctggaagtcctttggcagcaggtggccaattagtaggtattgtttcctggggtgtcccatgtgccactggtgtcccagatgtctacaccagagtctatgcttaccgcgattggatcagatattacactggattttaatctcctaaactcatctcatttgttatattgtaaattatgtaaataaatatgaaaaatgtataatgaaaatacttgttaaataaaagttacttttattaagaaaaaaaaaaaaaaaaaaaaaaaaaaaaaaaaaaaa

SEQ ID NO: 430 - DNA, 235 bp, Ctenocephalides felis
ttttttttttttagttttaataattattgtagatcaacatgttatattactttgcatagngngatatcggttactaaataccagtatgtttcttcacaaattctcttatttctggatcagctagtcttgtaaatacatttggatatggaaaacttgtgcaatttctagttgaaaaagctgtcaagcctactaaaaccccattttcgtcaacgacgggtccaccaaaatcacctgt

SEQ ID NO: 431 - DNA, 549 bp, Ctenocephalides felis
cggnggtgttattttaaataaagaatatgttcttactgcggcacactgtttcaatgatgtaactcatcattcggaaattcaagtcagagttggaagtacaaatgcttatcacggaggaataatcgtggatgttgaggacattacagtacacgaactttataatgaaaagttcacaaattatgatgtagctgttgtgaaattagcttatccattaagatttgataaaaatataaaagcagcggtactggcagaggatggatatgagccagaaataaattctaaggtcactgtatccggatggggtagtttgagctaccttggtccatacccagaagagctacaacaggtagatttgcaggtcgcagaccacgacgactgctcattgcttacatggcacacctcgacctgccgaaagtcaaatttgtgctccgtcctggtggagtcaaagactctgccaggtgactctggtggcccctgctgagaatggcgtcgcgtagcatgtgtccttggtgccgtgcgcggaccagatatcagagttatctagattgg

SEQ ID NO: 432 - DNA, 549 bp, Ctenocephalides felis
gaaaatcagaataaaatgcagaaattattgatactagtttcatttttatttcccttgatcgtctgtaaagaaaaccgaattattggtggagaagaagctaatatagcaaaacatggctggcaggtgtcacttttattattcggaaatcattattgtggtggagtaatcattgacaaaaattggattttaacagccgcacattgcattgaaaatgaaacaaatgccaataaaagatattcagttcgagttggaagtagtacacatgaaaagggcggaaaagtatacaaagtcaaagaggctattttacacccagaatatgatacttatacggtggactttgatgtagctctgattcgcctagccgaaccaattgcattcaccgcctgcacagtgcgcccaattcaaatagtagatgaaggagtaaaaacattggatggggcaatgttaactgtaccggatggggatccagacgactggtggagattaactacagaattaagaacgtaatgtccattattaataagaaaaatgtgatgaatttattctcca

SEQ ID NO: 433 - DNA, 549 bp, Ctenocephalides felis
gaagatatgaagacttttttcaaaatatcggttttaatcgatctgtatatgttgacaaatgttgctgcggaaaaaaattctggtcgaatagctggtggaaaaataatagatatatcaaaatgtggatggcaagtttcattgcaaacatttgatcagcatctttgtggtggttctataattaataatcattggatactgacagcagctcatggaaatgctgatacttattcaattcgtgttggaagctctaggcacgactccggtggtgttgtatataatgtcacaaaaattataagacatcccaaacacgatgaacaaacatttgattttgatgttgctctggtacgtgttaacacacctatcaagtttacagtatgtaatagtaaatccgtcaaaattgaagaaaaaggcatcgaaacacctccaggaaaaatggtccaagtcacaggatggggtgcagaacaagctggaggtcccgctcatatttcctgcaggaacatggttctattgnagcaatggatctgcaagaaatatgcagaagattaaaac

SEQ ID NO: 434 - DNA, 549 bp, Ctenocephalides felis
ttcaacttgtggatggcaagtttcgtttcacaataggaaaggacatttttgtggagggtccatcattggcaaagaatggattctaactgctgcgcattgtgtaaccaaatatgaaaacgatatcgaaggtttaaaagttagggttggaagcaatgagcataacaaaggtgggcgtttatacgacattaaagaaattaaaaaacatccaagatataacgatcgaaccagatacgattttgatgtcgctttattacgcattgcaaagccaattgcatacactgcttgcactgttgttcctgtagcattggcagaaactggaaaagaagttccagaaggcgcactcgttagtgtcacaggatggggggctactatggtgggcggccagcatcaacgcatctaaaaggtgttaagggtccaatcgtgtcaaatgaagaatgcaacaaaaattatccattcctggaggtctggatgacaaaatttcagacagcatgttttgcctggttcctgaaggcggaaaggactcgtgtcaaggagangcggtggcctgta

SEQ ID NO: 435 - DNA, 465 bp, Ctenocephalides felis
attgtattcagtgacaaagttcaaccaatcaaaattagcaaaagaaatatcaaggatggtgaaatctgcaaggccactggttggggtcgattggcggatggggccccagtaccaaacgaattacaacaagtggaaaccactgtaataacaaacgaaaagtgctacgaattgtctcaattcgttgaaccaacttcgcaaatatgtacattaaaagaatttggaagaggcatttgctttggtgattctggtggaccactggtttacaaagatgaactggttggcgtttcttcgtttctcttgtatacttgcggagctggacgcccagatgtttttgttaaagtgcgcgatttccaatcctggatcaattctgaaattagaaaaaattaaatagatatcaatcataatttcttgtaataaaaaatggttaaataaagacagcataatctaaaaaaaaaaaaaaaaaaa

SEQ ID NO: 436 - DNA, 549 bp, Ctenocephalides felis
gcnttaggcctatgcctaggtgaaaaagttatattcaataactataaagtttatagagtaattgctgacaacttcgaacaagttgaggttctgaagaatttggaaaaggactctgatgcgtacaatttctggacccatgttggagccccaggcaaaaatgtagacatcatggtacccccacacaaacttgaggatttcgaaagcacgatgcaataccatagaataaaccacagtgtaatgagcgatgacgtccagaaagatatcgacctagaagtttttggtacaagtagagaagcttacagttggaccaagtatcaagatcttgaaacaacctatgcatggatggacagcttagccaaggcacacccaggaaaagtcactgttctcaccattggcaaaacttttgagggaagagacatcaagggagtcaagatttcattcggaactggcaaaccaggcgtatttattgacgctggaatccacgcccgcgaatggatcacactgccactgcacttacatcttaaacgaattgtgactccaaagacgccg

SEQ ID NO: 437 - DNA, 549 bp, Ctenocephalides felis
gaaatataaaatttcttttgtatatattggttttatgaatgatcagatgagtggattttacagaagttcttacaccgaggacgggaaaacaaaatggattgccaccactcagttccagccaactcatgcccgaaaggctttcccatgcttcgacgaacctctttttaaggcaactttcgacatttctataattcgaccaaaacatatggcaactttaggaaacatgaaacatctgaggaaagatgaagtggttgcagaccatcctaatcgactgaaagacaccttcaaaaccacactcaaaatgtcatcttacattgttgcatttgttgtttcggaattcaaaagtgtttcccaaaaacctgatcaggaatttgatgtttgggcccgacccaatgcatatacgcagggtcaatacagttacgatattggaaaacaaactttggtaaattagaagagttactggctataattcgngccaaggatggaaaaatggnatggnagcttttctgttttctgagccttggagaactgggcttntacttcaggaac

SEQ ID NO: 438 - DNA, 549 bp, Ctenocephalides felis
aacaaaccttcgtggaggttttgtttaatatcatccagcgcgcagcaacctcaaagaacatgcacagaattaaagtctgacactctggacatccaatgccaaaggggatttcgctcagtgccctgcaccagccgtatgcagcccgggaccagggcaaacttggcatgcaaaccaggattccagttgctcaaagaaccagagttctcgcaaattaattgcggaaatgatgggatttgggataattgtttgttttcttgcgaaccagaatgtggaaatccaacaccaattgaaactgtttttaattcggacccacctgtaacgtacttagcaggtcaatatccatggtatgcaatgttgtttacccgaagggaagatttattcaaaggacaatttctattcagttgtggggggtcaataatcaactcacgaatgatagttacaactgcttatgcgctcataagccagaaatcgattggatgatcagagagtgtgtggatctagtgtattcgtttaataaacagagatnttatgctagcntacgaatagaaa

SEQ ID NO: 439 - DNA, 550 bp, Ctenocephalides felis
agcatttgtcagtggctgtgttttaatcaactgggttatcgtcattgcgataacaaataattagtataaaatcggccatttaataacactagccatcagttttcaatcgaacgttgaacaagaaacattaaaggataaaggggtaaaggatattttggatttttcaaaatgaagttgctagtattatttttaacattggtcgcctgcagtagcgccgtatccttctttgatttggtgaaggaagaatggagttcattcaagttggcccacaagaagcgctatgaaagtgaaaccgaagaaaagttccgtctcaagatcttcatggaaaacaaacacaaagttgcaaaacataaccaacgatatgaaatgggtttggaatcttacaaacaacgtatcaacaaatatgctgatatgttgcaccatgaattcgtccagactttgaatggattcaacaagaccagatcaaatgccttcgtcttgtggtgtcgaaaaattgcgtggagcactttcatctctctgcnacgtagaattgcaaacatgtgactgcgtg

SEQ ID NO: 440 - DNA, 550 bp, Ctenocephalides felis
gttcnnncgcccacanacattttcaaaatgctaaaagcancaacaataatttttatcgctttcaattttgtgtctggtggcgtttatgatggttacaaactttacgaaataagaccccaaacaaaatccgaggcttacgatttaatggaatggcaagtaaaaccaggagtcgatttctggtccgaagccaggatgctcaatcaggctagccaggttatgatctcacctgaacttcaggaggaattcgaaggatatctggtcaatggtaattatacttggaaagttgctgaggataacatagagagacttttacaagattttgaaagaagcagaaaaaagtcaagtgccccacgtgacgatggatttgatttcaatgattatcaaagatcgcaaacgatcaacttatacgtaaacaaattgccaaaacgtatccaaaatatgtgactgttaaggatgaaggaagaagttttgacagcgaatcatcaaatctgtccaattacagatggatcaattccaaaaacaagcgcgatggtgatcgctgtggtgccat

SEQ ID NO: 441 - DNA, 548 bp, Ctenocephalides felis
ctcctccaggtcctaaggacaatgatactatagcaatttataaatttttagatactgaattttatgctgaggttggaataggccatcctgtaaagtatttcaaacttgtggttgacactgcatgggcagaaacatgggtggcctcgaaacaatgtggattaaaatgtgttggatgttggaatcttaataaatatgactctttggcatcatcaacatttcaagaaaacggtaaagaattttcttttggctcaggcaaagaagccataacagggttcttttcaatagaaagtttttatattggccacataaatgttaaaaatcagacttttggggaagtaacatgtttgccatggcactacttgttttcaaaagcagatggagtattaggattagcattcagcagtttatctattggcaacataatgccaatattttataatatggttatcaacaattgattaagaaacctatattttctatttattgaatagagatccaacgcaaatcatctggttcatcatgatcgggcatcaaatcctaacattata

SEQ ID NO: 442 - DNA, 549 bp, Ctenocephalides felis
tttggctgatcctgataaggaaagtcaggctgaaccttcaccatacaattaccgatgggaaattccaataacgtacatcacgaatgttaaagacgattataaacttgaatggttcccgagggaagatgctcaaaaaactattcaagtagccgaagatgtcgaatggataaaactcaacaatgatcaaatcggatactacagagtcaattattctgaggaaatgtggcaaaaattgagcaatgctatgaagaaaaggataattagtttttcagcctcagacagagcccatttattaaatgatgccttttccttggccgaagcaactttgttgccctattcaactgctttggagatgacaacttatttggcaaatgaaatgcattatgttccatgggcagttgcctctactgaattttattctttgaaaaaattgctatttggaagtgaagttatgagaaatttacgaaatatgcactagaaattcttcagctgttatgatagaataaaatgggatgtcatgatgatgaaaacattngataacatctcnag

SEQ ID NO: 443 - DNA, 549 bp, Ctenocephalides felis
ctttgtctcagccaatccggctggaaggatcgttggaggcgagaacgctgatgatgcctctgctccttatcaggtttcactacaatttaaaaacttccacttttgtggaggttctattttgaacaaatactggatcattacagctgcacattgcatggggagacgttttgaggtagtagtcggtattaacagattagaccaggaaggctatagataccaagtagccgaaatagtcacattgccattcgattccgaaacaaataattatgatttggcacttgtaaaagttaagaagccaattaagttcaactacagggtacaaccaattcctttgggcgaagaatatgtcgaaggaggtgaagaagctcgtcttacaggatggggcagattaggagctgatgaccctgcaccaaacgaattgcaggaattgaacacttttaccatcagtcataaaatttgcaagaaagctcaccanatgtggttacccaagtcagatatgtgcatttgagaaaaagaaaagggctgctggtgacttgtggncattgncga

SEQ ID NO: 444 - DNA, 549 bp, Ctenocephalides felis
ggcatccaaaactttatctattttgtgcttttnggtattgttctacctagtttcggataccgaatcctttatcttaaagaccaataaaactgatgagaagatcgttggtggtgaggaaataagcataaagaaagttccttatcaagtatcattgctccattttaatggacaccgtgtgcggcggtgtgattctgactagacaatttgtcctgacagcggctcattgcttcatgttcgtctacagccacgaagaagtcaaagtacgtgttggcagttctgaaataaaccatggaggaatgatatttgatattgaattctatgctcttcatcctgactatccagaagaccatgatgacacatctgattatgacgtggctcttgttaaacttgcatatccgcttaagtttagcgaagacatccaaccgatcatgatggctgaaaaggactacgaaccaccagcaggaaccaaggcttatgtgtctggatggggcagaacatcgtcggtggcaattgctaaaaatcttagaggagttgatagaaataatagac

SEQ ID NO: 445 - DNA, 549 bp, Ctenocephalides felis
aaatgaagtctctattagcagtattgttgttggttgttgccacgtcggcaacaggaattgattggaaaaatgtgaaacctatcgagcaacctgccatcatgagcaatttgcctgcatggagaaaaactggagaacgtattgctgggggtgaagaagctacaccacaccagttcccattccaggtcgctgttcttgttcacatggatgatggcaaaagtgcattctgcggaggttccttgatttcccaaaactatgtgttgactgctgctcattgcgccgataaagcaaaatctttcaccgttgttctcggagctcacaatgtaaccgatgaaaacgaagccggaactttgagagtagagacttccactaaagttgtccacaaggactggaacagtttcttattgagaaacgacattgccttgttaagctgcatcaccagttcaattgaatgatcgtgtcaattatctcgattgccgaaaaaagccaagccacacccttttgatattgacgcactgcttaggtggggaagaatggagatctgtncacatt

SEQ ID NO: 446 - DNA, 549 bp, Ctenocephalides felis
gtancatcagctgctccaccagccagtgaaccccaagtattgggttttcccgatggattcccacgagttgtaggtggacacactgccaatgagcatcaattcccatggcaagtatccctccaaagatttggaagtcacttctgcggtggttccatcatcaattctgaatgggttcttactgctgctcattgcatcagtggcacttccggattcgatgccgtagtaggaaaacacgatctttcaaaaactgaagctactgaacagcgatctgccttcaagagaaccattgtgcacaaatcttatgctggaggcgtcaatccttatgacatcgctttgatccaagttgccacaccattcaagctgaacgaaaacgttaaagctgttaagcttcaactaaagatgaggctcactcaggacaagttacattgtctggatggggatctacttctacttcagcttcccagctccctaataaactacagactgtgacaaaccaatcgaccataccccggtgtgaaaaggtctaggaggagccgatctactcattga

SEQ ID NO: 447 - DNA, 549 bp, Ctenocephalides felis
ctgtagtcctagtattggccttagggctattatgcagtgatgtttctggtttcttcagtcttcggtcccgaaaaaccagagaacctgtcgaatttgtcccaaagtccaggcataacgtccaaactttgtgggtgactcaaaaattggaccacttcaatcctcacgataatagaacttgggaaatgaggtatatgtccaatgatgaacacttcaaagctggtggaccaattatcatatacattggaggtgaatggacaatcagtgctggagctttgattggtggtcaacaatatgatatcgcagtccaacataatggatatttattctatacagagcatcgttactacggtgaaagtcatccaacaccagatgcttctaccaagaatcttcagtacttgagcgtggatcaatcactggctgacttggcttactttgtgattatgtcaagagtcaaatcacaggagccaaagacagcaaagtaatcgtgtggtggatcttacgccgtagtatggtgttggtccgctaaatatcctcccagtgcgacattgc

SEQ ID NO: 448 - DNA, 520 bp, Ctenocephalides felis
atttggttggcattcaggatgtaaaaggagcttgtcatgccgatgaattgggatatttattcaaaaatgagttgtcacagtttccaaaggaattggagagtgctgtggtgacacagaagaggttgttgagtttgtggacaaattttgccaaaaccgggaatcctactccatcaacaagcaatttgttaccagtcaagtggttaccagctaccaaggaccaactggtttatttatcaattggtaaaaatctagaaataaaagttaatccaatgaaagaacgtatacaattttgggaacgagccaccaagaaagattatttgtcacgtttgtaatggaatatttttaaggaaaattacctatagaacaaatactactttatcagtaagttatgtatttcaactatttaaaaccttgcatatcttgaattaacagtgatttgataactttttgcatttttacgattttaatattatagtaaatataaatatgaattgtgtttttaaaaaaaaaaaaaaaaaaa

SEQ ID NO: 449 - DNA, 549 bp, Ctenocephalides felis
aattcggcaccagaagtgaccgagttagaagttctgtcgttttatttgtgatatttgttagaagtttattgtaaaaaagtagaagcaataaacatgaagagtttgctgctattcgtagcagtttttgctgctgcagcacacgccttacccacggcggaaccaactacgactgcagttccttgcacacctggagaaaccaaacaagaggattgcaatgaatgcatctgcaaagctgatggcacaggatatcaatgcactgaaagagaatgcaaacatgacccagaatcaaaagcagacgatcatggaaaaatttgcgaaccaggatcaacgaagaaagaagactgcaacacatgcacatgtactcctgatggtaaaaactatatgtgcacattgatgatgtgtggacatcatcatgaaaagagagaaactgaaattgaagaagtcaaagaagtcaccattcaatcacttgcactacccatgtctctggccaaaacaagattggattgnatcttgcaatgcgcagggtnggacaggtctttgaccgccagc

SEQ ID NO: 450 - DNA, 154 bp, Ctenocephalides felis
tgtgtgaagaatattaatgatgaacgagtatttgttgttctctatgctttgagtgctgtgtattttgctggtgtcatggttcgactgatgttaactctgactccggttgtctgtgtgctgtcgggaatagcattctcctgtctgctggacttgt

SEQ ID NO: 451 - DNA, 215 bp, Ctenocephalides felis
ctctagctcgccatgaatctacaagagcctcgagagttgttagaattgcagcagtgcaatttgcactacccgaaggactcaacacgtggactcctgtggctgaaatgagagaggctttgtatggaaaggctaggaatattatacaagctgctcatgataataatgttaatgtgctttgcttgcaggaagcatggacaatgccttttgggttttgt

SEQ ID NO: 452 - DNA, 160 bp, Ctenocephalides felis
ttatttcccaatgcanatgcactgctggtgatttgactcgtatggctacaattgttgccgacaaactaggtgcccaacctggttgtccaccaattacagctttgaccttcttgcgtccattacatgccatgtttangcaaagggctctggaattgggggt

SEQ ID NO: 453 - DNA, 322 bp, Ctenocephalides felis
ggggagaatttttagagattttagatgatagtagaaagtggtggaaagctcgcaatattcgcggtcaagtagctcacgttccacataccatagtcacacctcatgcttgtggatgcgatgatagttttcagagacaagactctggcagatcatctataggcgccagtgagggcccgtcaggacccgtacagagtccatcgtcagttgactggattcgcaaccagcatcaggtaaatgggaacgagcaaaaaattgatcctccaccacctccgccgttgccagtaggagaattgcgctccagacaagaatcaccggaaccggt

SEQ ID NO: 454 - DNA, 210 bp, Ctenocephalides felis; identical to SEQ ID NO: 197

SEQ ID NO: 455 - DNA, 464 bp, Ctenocephalides felis
gnagnnnntncngccgtcagtgtgctgggaattcggcttcgagcggggcgcccggggcaangtacggtgcacatatattgatgtggcatctcaatgtctanccataggtaatatacaacataccctctgcacacttttgcttcgagcaacatttcgaataagccgctgaagaacggaagctggtgcaccaccagtaacagcaccaagctggcaataaattactgctgtgaatcccgcgcttggtgaagctcctaaagcgtccaggtagaatggatatcgtgcccacgaatctgagaatctggttaaagtcaaaagtgcgccaggattcntattccatactagacccgatcgaacaggttctcctggtaaacgctcacggattatctataataagtaatataagttgtaatgattanttaaatttatataantaaatattggntaacgtaattataaaactatat

SEQ ID NO: 456 - DNA, 292 bp, Ctenocephalides felis
gtcattttacaagtgcattattttttagtaaaaccttcattatagtaatagcttggaaaacataaatgttacttcatttttatatacacggtgaatttgttggaaatggactatataataaaaatatatttcttcaagccgatcgaagggtggttacaattaaaaaatatatttctattatatagtctaagagaaaaatactctcataactcctgtgtatggtcttcggcaaacggggcattcttttactgacagcgaacactttatacaggacacgacatggccacaaggt

SEQ ID NO: 457 - DNA, 498 bp, Ctenocephalides felis
aaaactcacctaaagataaaaatgttgctgttcgaaaacaagaactccctgggcatgtaacttatcttgctgtgaattgtgatcatacagttttgtccatagtgttaacttctaatggaaactttatattacaattttatgatgttacttcatattataaacagacaatagtattagttagcgaagtaaggctacccagccctttgttacaaatgtcatggaatccctgtatagcaaatgtagtagctgctactttanaaaatggcacattgtggtcctgtgaatttggtaatggnctgaaaataaattcaacaggaaaatgatgtgcaagctttatcattatcatggagcccgaanggaaaacanattgtcattgggacaaaatctggcacattatgccaattcacaccagatttgaagccgtnaaaacatcagtgtntccnatatnaaagntccataattctgttcatggtgagcattatcagtttgagctacatt

SEQ ID NO: 458 - DNA, 498 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattaccataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttataaaaaaaaaanaaaanaaanaaaa

SEQ ID NO: 459 - DNA, 267 bp, Ctenocephalides felis
cccgctgtcggaccaaagtcgcttcatagctgctaaaagttcctcggaaaatgcttctgtatcctccatacgttggattacgtcaaagaccattttgccgtccgtctctctttcattgttcccaaaactaatgcccaaattgggcatggcccgcagtatggcaaccagtgattgaatggtattactgtaaacaactggtcgatattgtttgaagtcttcgcttgtgaaacccgactcatggataattttcatttgttttacgatagt

SEQ ID NO: 460 - DNA, 351 bp, Ctenocephalides felis
ttgcaacaatgatacgggagtgttggattgtaatgcacgccaaattttaactgtttttactgatgatgaatggaataaactaatggatgactccaaaactaacatcagtgttgtgcagatgcaaaataatgaattgactcatttattaccgtttcctgcacttgatataaaagttttagacttgagtctaaacagaattttaagaattgagccagcaactttcaaaaatctccaaaatttgacagagttgaacttaagtaataacaggttgacatcaaagtttttaattccatcagtttttgagggtgattattctccagatgcatatgagccattaaaatcgatgaaagt

SEQ ID NO: 461 - DNA, 500 bp, Ctenocephalides felis
ctttganttccnncctcngaagctcntngtgtgctncnaatttgcggaaacacctcagattttagcggcagcggaagaaatttgtggaccttatgtctggggccgttatgatttacttgttttacctccttcattcccttatggtggaatggaaaatccatgcttgacatttgtaacacctactctattggctggcgacagatcgctagtgagtgttgttgctcatgaaatagcacatagctggactggaaatttagtcacaaattgcagttttgaacatttctggctaaatgaaggtttcactgtatttgtagaatacaaaattcagggaaaattgcatggtgaagatgttagagactttcattcgctttgcggactcacaacattgaaagaagaggttcaactattaggtgaaaccaatcaactgactgctctcgttgttaacttacaaaatttaagtcctgacgatgcattttcttctataccttacatgaaaggct

SEQ ID NO: 462 - DNA, 176 bp, Ctenocephalides felis
ctgtcactggctgatgggtcgacgctcacctacgatctatacaaagctcttaatccggataaacatgaagatgaggtaactctggcagtgtgccctggcattggtaactcttcggagtcagtctacattcgcacatttgtccattacgcacaatattacggatacagatgtgccgt

SEQ ID NO: 463 - DNA, 498 bp, Ctenocephalides felis
cttattcctaaagctagtaatgccgaaagtaaggttttctatcttaagatgaagggagattactacaggtatctagctgaagtagcaacaggagaaacccgtaacaccgtcgtagatgattcacagaaagcttatcaagatgcatttgagatcagcaaggccaaaatgcagcctacacatcctattagattgggtcttgcacttaacttttccgtattttattatgaaatactaaattcacctgataaagcgtgtcaacttgcgaaacaggcattcgatgatgcgatagcagagctcgataccctaaatgaagattcatataaagattcaactctcataatgcaattgctgcgagataacttaacactgtggacatcagacacgcagggtgatggagatgagcctcaggaaggcggggacaactagtcctgaaaaccttacctatccacttccgtatccttaattcacccttatacaatcccttcgttatttggtaat

SEQ ID NO: 464 - DNA, 246 bp, Ctenocephalides felis
cagattcatgttgtaaaacagaaataccaatgtgtgggaaaagtgaccatcccagcaatattccttatacgggttgtatacacagtatgactgatagattggaacatcaactttggcttttaggagcagtaggcctgggaatgtgcgctttgcccgtatttggaatgatattcaactgttgcctttatataaaattgaaagattttattgacgattgaaaaaaattatttgaaattattttaacgt

SEQ ID NO: 465 - DNA, 477 bp, Ctenocephalides felis
atctttatcagtgagccagttagacataacgtgaccacatatacctacagcatcccattcaatgttagatagacctgatacatcggagtaagtagcctgcgaaagcaaatgctgtaaggcgtgtccaaatttgttgaataaaattgatacctcttttagagacagaagagaaggtatattgccctcaggagggatttagacttaaaattaatgatgctaatggtgttgtatccacaattttacttttattgcgcatactcaacatccatcctgaactcttttggaatatcttctcttcttctctagtataaggatctaaataaaatcagccagtggcaattcagctgcagaatcatgtatatcaaaataccttacatctttatgccaagnattcatatttgcctttcgataattttnataccatcaacttttnacacaactggaatagccccgtcnaaaacctttggaatnggaagn

SEQ ID NO: 466 - DNA, 395 bp, Ctenocephalides felis
ttagcccaagtttcacagcaggtttggcagtcactataatagtatgctccctttcattttctcctgaaccaactttgcatgtgtaagagccagcatcatcttgttcagttttttcaataatgaattgatgttcttcctttattaattggtaacggtccttgagatcattgatttcttctacttttttctcatctttaaaccactgatcaacaggaccatctttcaatggacaggttagaaccaatggactacgaatatcaaaaagtttttgcgacgtggcttcaccttctctggcataaacactgctttggaccaaaaataataaaattgcactacacaaaaactgcttcatatttattgaattttcttcccctcgattgaaatagttcataagt

SEQ ID NO: 467 - DNA, 211 bp, Ctenocephalides felis
ggaagcaccttaggctgtgcagggacatgtaactgtatagcattttgtgcccagagccataggtccgcaattatgacgtaacggatcatatgcaaaatttgcggggcaataatattgggttcctatactattttcgtcacaataataatagctttgacaatcatttatatttggataaaatctcgatggtgacggacatttgaaaccttgt

SEQ ID NO: 468 - DNA, 500 bp, Ctenocephalides felis
ncantggccatttttatcagttctttctttatcaactgattgttgagtttttgctctnagtgtttcancnaattcttcantagccgtctccaagaagacccctcattctataaacaactctcattgattctccttcgcattgnncagccaaccacacctttttataaacttctttcactggaagatccaaactcatgattttgttgntgaccagtaattccataccattgncatcttctaataatgctactaattcacaatcttgacaaatnttatttttaacatctctcattaatggccaagaccaggntcattctggaatatggattacccaacatgcgaccctgtaaaaagtcttcttgttgaggatccttctcaagagataagaaaaattccccaatatcattttcttctggataataattgagcaaagctttaaatataaatacaggagttcgacatcntcaatggatattattactgnttccatgccccagaca

SEQ ID NO: 469 - DNA, 251 bp, Ctenocephalides felis
aataaatataattttattatataagaaacatatgtataacaatacaaattataactatttaacagtcttcttgtgataatttcttgacggccgtatctgtagactttgatacaccttttttcggtaagctccagaacacctgatccctgccgaatacgtgagcttcagttagcgtttccggtaacttttggtgtaaagtttccggcaagaacattccggaagtcgcgcccaccatcatcattacggaaagt

SEQ ID NO: 470 - DNA, 498 bp, Ctenocephalides felis
caataaatattgaatttacaggcttatgaacaccattaagagtaaacctcaatttgatcacagcacccttctctcccaactcaattttcttcgtataccccatgtaattgatatgattagccctttcctcttcctcgaaataaacccaattatgtagacctgttacttcacaattttttaattcagctaagaaaacatgctcaaatgctgaactaccgattttgcccctcctctggagtataaattaaaccaaatcgttttcaataaatccttatgagtttggggatctctagtcacaattcccttttcaataaaaaaattcataagatgtcgcatcaggctggtggataacattgcatctaacaaagcattttcttcatttctttcttgtgcagttacatgttcatttactgcagtatctaattcataattattaaataatggtttcataagcgctatagttttaatatcaaaagctgctgattcacaacaagcaat

SEQ ID NO: 471 - DNA, 105 bp, Ctenocephalides felis
agaggggtagcttttattccatttattgatgacatgccttcttttaatcgcaaagtggatggaccatttataatgcctgttgtagacaagtataaagacatgggt

SEQ ID NO: 472 - DNA, 496 bp, Ctenocephalides felis
ttttttttttttttttttttttttgaaccattttataaaattttataatcaantcantactataaatttataataatatcaataacaaaagttattttatagtagtcataatatactttgcattaatanttcatacacacacacacacattacttgtcttttcaattccaatttgttcttattctcgtccttgttcaaatgtcgatgttcaatgttgtattaagcattctattgtgantttagtattggatttcttaacattaaagcagcttctgatgatattattggcaacgcattgacacaatgatantttattaaatgtgaaatactttcaaacattntatctctggtgtcgaaccactcctttaggatcaataagtaataaatgcttcttattaactccttgaataccagtcagcacatattgccaggacttgctcgtgactctngaactagaaaatctncatnngttttaccaaaccctnagaacaactnt

SEQ ID NO: 473 - DNA, 500 bp, Ctenocephalides felis
aaataattcaggagccccgcaaagtcaganttctatatgactttgaagcagcagaaganggacganttgaccttcttagctggtgaaataatccatatgctagatgattcacatcctanttggtggaaaggatataatcaacatggagaaggtttatttcctgcaaactttgtaactgctgatttatcaagttgaaccagaacantttagaattgatgctaacaagaaatctgttcanttttctgatgctgttcangtcaaaactatatctcatgatgatgaaaccagtcctgaaattaatgaagaaagtatagatactttattaaatttattacatgaagcaaatcctgaanatcctaatgatgatacagagcaaatgctcaacttagangttcangtaaataaaatgggccctctgattgatgctgaattaagaaaatattgacaggaaacatgctcaacttacgcaattgagtggcgatttagtagaagcacttant

SEQ ID NO: 474 - DNA, 500 bp, Ctenocephalides felis
tttttttttttttttttttttttttttttttctgacagactcgagctaggngnaaaaaactacatttttacagatgcgattaatgaaaattaaagtttgctactaatccacatctatccttgattctgtttttgctgctaatgtgccacaatgaaatttagatgctctcattttnttaaaactaagtgttaaatcatccattgtaattggtcgtagagcatcatgaaattcctcttctgcgtcttgtatgtgtggcaccaaaggtgattcagngtgcatataatctctaactntatacacagaagcatttcggcataattcccttaagtctgatcctgaaaatccctcagtgagtttagataattcatntaaatcaacttcatctgaaataggttcattttctaaaataagctctagtatcttgaatctttgntgncttatgggcatgccaatatggaatgnggctggcatacnccgnaaaaatgctttatttnaatttn

SEQ ID NO: 475 - DNA, 462 bp, Ctenocephalides felis
ttggtccaactgtttggcatttgtggatatattcaaaatcagccaatgctaattttttttnggtgttacattggcatttgctacagcacagatttttttagtcactgatatcttatttgcctatattaaaagagaatataccttgaagagtggcttgaaacgaatattgaaaggcaaacctgcaaaattagctttagaataattttattataatgtttgaattgaaatgtntttgantttaaatatganttaagttttaaataaaagcttttttatttttacattataatattatgccattagcctatattgttacacagttaaatttaaangtatttaataaatgggtttacaactaaacaaatcacaaacacacataaatataataaaaactggatgaaaatanttgaatatatatataantcgtnaagaangtcaaccttctgnnataatggagcttgt

SEQ ID NO: 476 - DNA, 549 bp, Ctenocephalides felis
gnttgactgacctgaaataataaatatcataactgcctgtgtaattttttatttgtgtgttatacggtctttaaataaataaaggtttcttaaaaatgccgctaataatcatgacaggaatacccagtagtggaaaaactcatcgaacactagaaataaaaaaatatttcgaggaagaaagaaagaaaacagtacatgtggtttctgaatttgaagccgtcacaaaatcaggttattcaaaaaatgatatttatcttgatgcccaaaaagaaaaaatcgttcggggcattctaaaatctgaagtttttcgattattgacgaaggataatgttgttattctagatggaggaaattatataaaaggatacagatacgaattatattgtgggagcaaagctgcacgagttcctcaatgcacaatttggacatctatatctaaagatgatgcttggaagttcaaccaaaattcaccttccatatcaaaagaagttttgtgagctttgttttcggatgaagacctaatccaacaaatcgtggggatctnctttt

SEQ ID NO: 477 - DNA, 549 bp, Ctenocephalides felis
gatgacagtaccatcattcaaaggcaatataacagtcttcaccaatagttacttgggactcggtttaaaagctgccagacatgcagtttttacgaaaaacaatggagactccaaatcgttgtccagcccttgtattaatcctatcatcaaaaacaaaccttgggtgtatggcaacgttgagtacagtataagtggcactccgctagaatcaaagaaattagaagtagattggccaaaatgccgcaaattattagcagacaccctgttacctctagtcgacccaaaacctataggtttagaagtacaagatattgcagcgttcagctatttctttgacagggctaccggggctggactgatagatccatttttgggcggcgaaataacagttggggaatttgaaaaaactgcaaaagccgtttgcaaaaccgcaaacaccgaccagcccttcatgtgtttcgatctaacattcatatcggcttgctaaaggacggattcggattaaaacctgaatcgaattaaaatactaaaaaagatcgcaccacaaat

SEQ ID NO: 478 - DNA, 417 bp, Ctenocephalides felis
gttaagagctgtcaaattattgtacaaatatttctaaattaaatacgtatatataatttaataaataatattttactactatgaaaagagccgcaaaaaaccttctactagaccgtctgcacaaaggcgccgtcatggcctgcatgggcatcaccgttttgggaacactcagtcttggattccgagtttatcaatactttactgatataaaacctgaaatacaaagaaaacaaatattggcaaagaacgagctgttaaaagaaggagcctcggacatatcattatacgagagcaatatcacgttaaaggaataactcctaggatagtagatatatttagtactgattactccaaaaatgtatgttatataatgtaaataagacttataatttatttcaaaaaaaaaaaaaaaaaaaa

SEQ ID NO: 479 - DNA, 549 bp, Ctenocephalides felis
gttaaccgaaatccgaattataaaatttataaagtcaacgcagcaaattttgaaatcgtcgatattgaatcgtggtactacgatttagccgaggcaaataaaaattctattgtaaacccagaatggaaacaaatgtacggttcattcaagacagagtttggcttaaattcattgaacagttcagagatgcacaggcttgtattgaatatgaaaaccaacaataaacttggaaaaaaatattttgaatacaaagttaaacgtgctgatcctgaattaaaaaaaggctgtgataaaacctgtcttaaaaatcatttgtgcgcaatagttaccacagttgtatcagatctcatccagtgcaaaaatatcatcaaatcatcatcaagcattcttcagcatttgaatatatatgtcctaggagctattgtaatttccaattatttattattataaagtcatttttgttaagttattataaattagaataaatcattatgtggaaatatgtaacgcttgaaaagctagacaaatcaatattttagaaaaaaaaaa

SEQ ID NO: 480 - DNA, 549 bp, Ctenocephalides felis
gcacatttgtgttaagttttaagcaggaaagttgaacataaaataacatntnntnnttnttttgcgtgtctttaacaatggatgttgaaaacgtcgaagcatctggaagtgttccaaatgttgctggagatgcatgtggggattctatggtcacggatgggaacgaaacccctgcaagtgccactggcgcagcaggtttagcccaagaaagagttaaacgtaaagctaaaagaattgtacgacaaaatagtcgagaaaacgtggcctcaggagcggtgttaccacaacgttcttggaaaaacagccgcagacctagaaatggtcatgggagagggctgcccaaaaaaggtggcgcggggggtaaaggagtctggggattaccaggctcagagcttttagaagagtatgaagatatcaatgatccaaactttgatactgaatgtataagtcacaaagatatagagttgaaggccgtattcctgaagtttctgcagaagaattcttgaaaaaggctgacccgtattcttgattttgacatgggatcccaag

SEQ ID NO: 481 - DNA, 549 bp, Ctenocephalides felis
ggnttatttaattagaagactgttaagttttagaagatatgactgtagtttaacagtttatacgttttataaatcagcttctgaaactttaatttcataatgatttctggcgattttcctgaggacccagaaaaggagctgcagagtttagaagatgatgttgttcaagaaattctcaaaactggcactgatctgagacaatactcgaaacaaatagaaaaagaactgaaagatgtagaaaataaatctatacaggattatattaaagaaagccaaaatatagctagcttgcacaatcaaattggggcttgcgatgacatccttgaaagaatggaagatatgttaatgagttttcagagtgttttaggtaatatcagttctgaaataacgtctctacaaaaaaaatctgtttcaatgtccattcaattatcaaataggcaggctgtcgaggagatctctcacagttatcgaagatatttctgtactcaaagtctgtaccggaattttggatacccagtactgagaaagattataactcagttcaaatac

SEQ ID NO: 482 - DNA, 549 bp, Ctenocephalides felis
gtgaaagagaggctacaaaaagacttcttgcacagctaccaataagcgcacaatcatatagcagttctccttatctggatttgtcattgtttagctatgatgacaaatgggtatcagttatggagagacctaaagcttgtggggaatatcctattagattttatgcacgtgattctggccttctcaagtttcgaatatatgcaggagctgttgctaaaacaccacctgcagccactagaagattggtagcttttacatttcatcctaatgaaccatttgccattagtgttcagaggacaaattctgagtatattgtaaactttcatgtcagacatgctagctagtttttacaaattatttgcaaaagctaaaaaggttacatgatgtaatcaattaggtgggtgttgagaagatttgaaggtaattttaactcaaaacatatctttataatgaaattgnaatattaacatgcgcatatgttgtgatcaatttaaagtggtatagatgatgtgcctttgngcagggatgnagttgattattatagatatc

SEQ ID NO: 483 - DNA, 550 bp, Ctenocephalides felis
aagccgcatttgttattgagaaatatatgctaaaatatattgtctcagaattaatataatgtgctgagtttgcattaatattgaaacgttttattcattctgaggcatctatataaaataaataaatatgaaagcaattttgataacattgatagtcgccgcggctgtgtattccgtaaggcctgaggttttcctggaagaaaacttcgtagacgatacgtggacaaatacatgggtttatagtgaacaccctggcaaagaattcggcaaattcgtgcacactgccggaaagttctataacgatgccgaagcagacaaaggtttgcaaacaagtcaagatgctaggttctacgctctatctcataagttcaaacctttctcaaataaagacaagacattagttgtcaattttctgttaaacatgaacaaaacattgactgtggaggtggtacttgaaggtgtcgattgaagttgaatcaaaaggacatgcatggtnaagtcctatgaaatatgtttggcctgcatttgggccaggaactaaaaggtccgt

SEQ ID NO: 484 - DNA, 550 bp, Ctenocephalides felis
cgtgcaattaaattgtgtcaaatttcaaatctaccctgccaaaagggccacattgattatttaaagtccctcgcactcacacgcacggcaccactatgtctacggtcgacaaggaagaattggtgcaacgagccaaactggcagagcaggccgaaagatacgatgatatggctgcggcgatgaaggctgttacggaaaccggtgtggaattatccaatgaagaaaggaaccttttatctgttgcctataaaaatgtggttggggcgcggcgttcatcatggcgtgttatctcctccatcgaacaaaaaacagagggttccgaaagaaaacaacagatggcaaaggagtatcgggaaaaagttgaaaaggaacttcgtgaaatttgttacgacgtactgggccttcttgacaagtaccttattcctaaagctagtaatgccgaaagtaaggtttctatcttaagatgaagggagatactacaggtatctagctgaagtagcaacaggagaaacccgtacancgcgtagatgatcacagaagctatcaagat

SEQ ID NO: 485 - DNA, 550 bp, Ctenocephalides felis
gtttcgggcgccatgaagctaattgaagagaaaactgaccgcgtccacgtcctgaaccaggcgtcggtggacacctggagcgtggccagagagattgcggcagctagcacggtagctgatgaagaagatgcattttatgtgtgtgatatcggggatatcgttaagaagtatcaattgtggaaggagcatatgccgagagtgcgaccattttatgccgtgaaatgcaatgacagtccgattgtattggacgtactggccgcactcggaaccgggttcgattgtgcgtccaaggttgaaattaataaggtgctgccaatgggtgtcaaaccagaggacatcgtgtttgcaaacccttccaagccggcgagtcacatcaggcatgctgctcgacgggggtggcgaagatgacctttgacaacgaatacgaacttcataagatcaagagattttacccaaatgccagattgattattcgcattcgtgtgattctgaaattgccaatgccactcggaatgaaattggctgcgatgcattcaatgaaccccgcgct

SEQ ID NO: 486 - DNA, 549 bp, Ctenocephalides felis
atcgcgaataaataaatgtggcgatacattaaatcttcattattagtgaacaaggaactgatttaatatggaagataagcctgtgaagccatgtaaagagaagcgaaggaacaatgagaagcgtaaggaaaaatcccggaatgctgcacgataccgcagatcacgggagaccgagattttcactgagctggcggaatgtttgcctcttgctaaagaggacacggaccatcttgacaagacctcaataatgcgactgacaatctcgtatttgcgaatccgagctgccgtacctcaaattgttccagaagaggatatttgctcaacctcattatcgaataaggacaatgaaaacttcttattacaggcgcttggaggatttttgatcatgatctcacctgaaaacgatatcgtatacgtatcaagcaatgtcaacgaatatcttggaattactcagatcgatttaatgggtcaaagatgttcgactcagtcatccttgtgatcataatgaattaaagaacccttccccaactcaaccacaaaagatgntac

SEQ ID NO: 487 - DNA, 549 bp, Ctenocephalides felis
caccacatccagttgaattattttaacatttactttttgccaacatatgtcaacgcgttctttaatctgtgtttgaagatcaagtgatataatttagaataaagtagtttcaattatagtatgtccacaatgaatccagaatatgattacttgtttaaactgctcttgattggtgattcaggtgttggaaaatcttgtctacttttacggtttgcggatgatacttatacagaaagttatataagcacaattggtgtagattttaaaattagaactatcgacttagatggaaaaaccataaaattacaaatttgggatacagcaggtcaagaacggtttcgaactataacttcatcatattccgtggggcacatggaatcattgttgtatatgattgcacagatcaagagtctttcggaaatgttaagcaatggctcgaagaaattgatcgctatgcttgtgatagtgnaataaatacttgaggcaaccaagagtgattaactccnaaaaagttgtagactcactntgtaagaattnctgccagntaga

SEQ ID NO: 488 - DNA, 549 bp, Ctenocephalides felis
cagcgatcagatttaccagacacatctcattggcaaagttcaatttccaaagatgaagctgcntttgaaatagactactgcaatcctcaatcaagcaatcaacattcgaagncaactaaagataataacaatgacggtactactgntccagacgaagattttttttcgctcattatgaaaatacaaagtggaaggatggatgaccagcgagcaagtataaatataaaacgagtaatatagaactctactttaataattgtaataatattgtatatggattattagattacttttaatactagaatatttccaattttttaatatcattttttgtggattacatacatagaatagtctggctatcgattggtactttgactatgaattgttgtacctttgaaccgcaacaatttctaatataaaatgagtagaaggtttattagcgacataatagtgacattgctataatatagcatttaaatcaaacaaattaaaaatgtgattttattaataggtactatcataaagtcacaaaagcccttccggtac

SEQ ID NO: 489 - DNA, 547 bp, Ctenocephalides felis
tgacaaaggcaaaaatgggtcgtcgaccggccagatgttatcgctattgcaaaaacaagccctaccccaaatctcggttctgtcgtggtgtgccagacgctaaaattcgtatcttcgatttgggtaagaagaaggcaggcgtagaagattttccactatgtgtgcatcttgtatctgatgaatatgaacaattgagttctgaggcactggaagcaggacgtatttgctgtaacaaatacctcgttaagaattgtggtaaagatcaattccacatcagaatgaggctgcatcctttccatgttatccgcatcaataaaatgttatcgtgtgccggagctgataggctccaaactggaatgcgtggtgcttttggaaaaccacaaggtactgttgctagagttcacatcggtcaaccaatcatgtctgttcgttccagtgacagatacaaggccgctgttgtaaagctctgcgtcgtgctaagttcaagtcctgcagacaaagactatgtttcaagaatgggattactaatttgacctgatgttatana

SEQ ID NO: 490 - DNA, 353 bp, Ctenocephalides felis
tgataaattgcctgcaagaatgagtttcagggaacgaaaagaatcggccaaatgcatgcaaaaggttgcattaaatatacaactagcagcagccagagtttcaactgatgttggcattaaagtaggagaagccctcaggaatgtagtggaacttcgtttagatttgggaaaatgttcttcagacaatttgaataaatgggaatccagattggaagaaattaatgatgttgtggaaaattgcatcgtgtgaaattgtaacttgaaataatttttcttaactattagttttatagatgaacaaatacataatctaataaaccagcaagtgaaaaaaaaaaaaaaaaaaaaaaaaa

SEQ ID NO: 491 - DNA, 373 bp, Ctenocephalides felis
ntgnttccatccatattcatcacccaaatcacgttccatatcatctatttcctcatctttactatancttgcataatctttgcgtantgttctcancanaatcatagacacaagtcctactaaaantagtaccancatananctgttanatangctgaaccaatgtatcctatgttgaaagaagttangatccaantacttgtcaaacctattttcaancttgacattgcngggtttccatgtcacttcnnaagtnaanntcanaacngctccagttttanngtagttctttcttacnanatganacantcacatctacnanttgcgtgncantatatcnannnncaaatttcttgtgtgtgtagacntagtt

SEQ ID NO: 492 - DNA, 498 bp, Ctenocephalides felis
attgaaaaagttaaaattccaagtaaagatgttgacaaaataattttctgcctaaatttttataaagatatgagatttaagaacaattgaaaatttactatatatacatattacaaaaattcaaataattgttattctttgtcaaatacgttgttctttttcatgattacgatcattgtcagctgggtcatgtttcacatgtgatgtgtatatatcatatcccaaggatattgtattatcatataacactctaaacctatgaggtaatatataaaagtttatgatttgggctggcggccaaactacccattcagcagcgtaaagcctccaagcctttttcttaatttcctctattaattcatctttactagttttttctagtatagctaatgtaataaagaacatagaaatgcatattggtgagcatacaatttgatctatcacaacttttttcatgactattcctattgtgcgtcctggcaatcgtttatctagata

SEQ ID NO: 493 - DNA, 308 bp, Ctenocephalides felis
tgggaacagttaatttaaaataacaaaatgaaaggaacattattaatattatcatgtcctgtgatcatgataagtgccgaatatgctgacgtagatgtgtgccaagatttggacgatggaacttttcttgctgattcaaacaattgccaaaatttcttcatttgtgatggaggccgagcttggaaaatgtattgtccaggatcacttttatggaatgatcacgaaggaacatgtgattacgcacaaaatgtagaatgttaccaaccagaataaaacattttaatatcaaaaaaaaaaaaaaaaaaaaa

SEQ ID NO: 494 - DNA, 500 bp, Ctenocephalides felis
ctattacaactaggttaatttgttagtaagttttgttataactgttattgatattaaatatgtattatttttatatatgtaaacgaattataatttttgctctttgattacttctactctggtgcattaacttttattcaactagattaaatttttggtttacttcctatgcctcacatcagtgtccttcatgtgatcaggagtattttttcgatctggactttgatctgtatcactctcctccatttcagctttgttgcgtttcttttcataaatgagaataatcgcgcataaaattattacttcagcacagatcccaaaaatggccacaaagcagctaatttatcttgaactcgaaccaaggntgtagaattaacagtaattccaatgccttgattagtagcaatacatgtatattctcctcgatcgctttttcagccaaatcaatttccaagcagaatttggttattgcatgatcaacaattgatcgacggntgatc

SEQ ID NO: 495 - DNA, 244 bp, Ctenocephalides felis
gatcggttgcaatttgtcattgcaccaagcataaattgatgggtccggtgcataggttataaaagaattgggatttgtgcatttcatgacggtgcaatcagcttctgacgatttctttttacacatatttttagaatgatcatatacatagttaggtgggcattcgaaaacctgacctttaccatctttgcagaataagtatcttgtgcagtctttcggatctggctgatatcctacaaccgcg

SEQ ID NO: 496 - DNA, 500 bp, Ctenocephalides felis
ccaatatcgaagtgcgtgttcggccgccacgctcaatggagatccgtttagatgtgtttgccaataacaaacgcatttatttcgacagaccttctctcaagtttcaacacttccaaggtgttactgtatatacaccaacatacatcttgaatcagtctgaagttgttataatgtttgcttccggagccggagtagaagttgtagaaaatcaaggatttatgactgctagagtttatttaccatggacatttattaataaaactgctggtctactcggaaattggagttgggatatggcagacgactttgtcaaacctgatggaacttttgtgcctgttaatctcaacagttttgaatctgttcataaagatttcgcacgtcactggatgctggcggatcgtgnaaatgaacacctcggagcngnactcttnacttcgngaatttggtcgcncagccagttattatgcaaattcctcattttaccaaactgggttaaagaa

SEQ ID NO: 497 - DNA, 411 bp, Ctenocephalides felis
ttgtcattnttgttctactttgaagttgtgcgctggacaagaaaccccaattacaacaatcaattgtagagactcaaattccgatgctccattttgtgtagatgatatgtgctcatcaaaacctggggaaaactgtaagacggcagaaactacatgcgcggntgnaggatatcagccagaatccgaaagactgcacaagatacttattctgcaaagatggtaaaggtcaggttttcgaatgcccacctaactatgtatatgatcattctaaaaatatgtgtaaaaagaaatcgcagaagctgattgcaccgtcatgaaatgcacaaatccaattcttttatacctatgcaccggcccatcaatttatgcttggtgcaatggcaaaatggacccgatcggcccctgaatggg

SEQ ID NO: 498 - DNA, 498 bp, Ctenocephalides felis
ccccatatttctttgctcgtttagttgngcaacagcagcatcttttaaagaatacaaatggggcatttccatttcagtttttgctaggcataatgctttttcaaacatttcaattgcacgctcaagattccctcgttgaacctcaatagttcctaaagtttcatagccaaattcacatttgggatcaagtgaaatagcttcattaatcaattgaactgcagtatcaacatcacctgtccattgcaaccttagtaatcctttatgaacataaacaatagcattattaggctcaatttcaatggctttagagaaatatgaatctgctttggagtattgtctttgatcacaaagcacttgtgcatataaagnatagcactctatacagagaggaaattttttaatggcattgncaaaggcccaattatttcttttgccttattcatgtcntaacagcaaaagcatatcgatggtcgtatatattttttggacataagccat

SEQ ID NO: 499 - DNA, 598 bp, Ctenocephalides felis
tccaatataaagaaactctgtcacattgccatagaaaggattcaatacaaaatttatgccaacttataactggagatgccttactctattctatgtttcnagaanaatcagttcccgtgacttgccctttgaaaggacctttcacattcacatataatangggacatggcgaatgtatgaatccagtatcgaacattgaaagttgcactgaagacagtcgacttattttaacataccaggcatgtccggatgttcatggaactgaaagtgcantggaagaactggagtgtctagcaacatggaatgaaggtaatgctcgatacctggttggtaaaatgaatcatcgacatgccataaccagtgaagatcgatacagatgctttgtttatgagaaaataactggaattggagataaagtaatggatacaaaattgcacaatcatgagatgctacttgcaatggattgtttagtgctacagaaggtcacggacaatgactttaanacaagctgctattcctgagcggtgtcgtttccgaattggttanctgctggaccatcacactggcaaacagttgataatcacaanttactggttca

SEQ ID NO: 500 - DNA, 462 bp, Ctenocephalides felis
ccaaatattgcagttcctacacgaacaatattgctgcccatttcaatcgcttgttcaaagtcatcagacattcccatagataaattaacttcttttggttctaaatttaattccttgcataattgctcacgacattgttttaaagtgagaaaatctgggttgggtcctaaacttgtatcatagccatattttccaatagtcattaaaccatcaacaagtaggtttgggcaattttctttcacatatttgtatanagttgttgcttcatttgggtgaacaccatgtttttctatttcaccacttgtanttatttgaatcataactcntaatttatcaccatgaattttattagctgaatctaattttgaccaancattctgcacactgtcgggntaatttaaatgagtgaattgtttcnaccacnatatatcncaggtatgttaacaccttaanaattttant

SEQ ID NO: 501 - DNA, 216 bp, Ctenocephalides felis
agactgaccctgggcccaggcgtttgcttaanttgtgacgttaaagacgaccaaccacagtgnacgaatgatgaaataagcccatccacaactgctccaagttcaaacgtgaatgaaagcaatggaaacctcaccgaatcacaacccttaagccaaaatacttcaacaaatactccattagaaacatcaaatacctcactagcagaaagcagcagt

SEQ ID NO: 502 - DNA, 489 bp, Ctenocephalides felis
ttgttgtattccatgcccactgaatccagttgctatatatgtattattgtgatatggatgcaatcctataatgccattttcatcaaaggtattgtattcgtaataaccagcccaagcacttttaactttaattgcttcaaaacatggaacacgatgtgctaaatgtggccaaacgttttgttcaaaataatccatatctacatctaagttatcgactggcggttctttgtcaggatctggtgaacgaccacagatatatctgccacctaatccatctcttctaaaatatgtatttgttggatcgattgtcagaggtgtatttaaacctggaggcgaatgatgttgacactcaaagctatacacatatctttccacaggtaaaggaattgacagcaatccttctccagtaccaattttagctaatctggcaacatgaccagactgangtcctgcagctatgacacatattgcaaactttattgggtataa

SEQ ID NO: 503 - DNA, 425 bp, Ctenocephalides felis
gatcggttgcaatttgtcattgcaccaagcataaattgatgggtccggtgcataggttataaaagaattgggatttgtgcatttcatgacggtgcaatcagcttctgacgatttctttttacacatatttttagaatgatcatatacatagttaggtgggcattcgaaaacctgacctttaccatctttgcagaataagtatcttggtgcagtctttcggatctgggctgatatcctacaaccgcgcatgtagtttctgccgtcttacagttttcccaaaggttttgatgaccacatatcatctacacaaaatggancatcggaatttgagtctctgcanttgatngttgtaattggggtttcttgtcaagcgcacancttcaanntagaccantcgtgncaaangttcccaactgcttattatt

SEQ ID NO: 504 - DNA, 203 bp, Ctenocephalides felis
gaattgtttgagaattgctcagtgttaatcctttgagatgtggatcgaaggattgacaaaagtctctgaattctgtcagtgtggggcctaatgttaagtcggagtgcgtgcaatttaaaagaagacttagaattgcttgggttgcacatgcattgttgatcacctgttttgcaaagaatattttatcgagtctaccatcatgt

SEQ ID NO: 505 - DNA, 317 bp, Ctenocephalides felis
attggagaatttggatttttcttaacacctatgataggcaaacaaaaagtagcttttaattcaggatgggtaacatgtgcttttttgaacctaagagccataggtctgataaatctttcgaattttggaggtttacgtgtaaagccttcaccaacaaaagtaacttttgtaaccattctcttccacgctttccttctggactttcctgatgataaaactttgaatacttcagcatctgcctgagctctgacttttggatangcacatcccattttccggccttctctttacgtttctgtttgatcatattagagagt

SEQ ID NO: 506 - DNA, 518 bp, Ctenocephalides felis
ctctaanaatcattgacgctttttcntttctttcactgcctttgttttanatggttgtcctcggttcanaaaagacgtaangacttctgacatttctggcatatcagacatctttgtgaaactgctgagttgctccatttcctttttagtttcaggatcattcatcattttcggtaaaancataattaataataatggcaanaccatcattaatatcatatgattgaataggaaatcagtgattttccattgttcccttacttgaaaatatctgaattttcctaatgtctttaatcttaaagggtatggcacttgtatgacttgagatgtttgtaagtgattcactttgcgtgctcngaattttcctttanagttaatttctactctaacaggctcatacatataanttgngttaactgcatccaanacgtangatccagatgggacattanttataacaaangtgccgtctcnttcaaaaaacctctgtatnancccccgttcaanantattttggt

SEQ ID NO: 507 - DNA, 373 bp, Ctenocephalides felis
ttttttanctaantgtatgtcagaaaatgtcactaaagcaacacctgtgatgcttaaacaaactgcaattaatttggatatagtaaatctatctccgatattacaagggaataaagcagctaaaacaagtgtgaataaacttgacgttgaagataaaactgtaaccgtancagcttctgtttgtgataatgccagctgaaatgtgtaattagcagcaaaccacaataagcagaataacaaagcaatttttgctattctttgtgtgggcaaacgatttgcggcccgccgtgcagcctcgcttgcccttaaacttgcgtgggaagataatcttgccaataatgcttctgttgctcnattatcacgcatttgccgt

SEQ ID NO: 508 - DNA, 430 bp, Ctenocephalides felis
gtattcaatggtatgaattgcttggtgantgaaaatttcactcatgggttcttcttcgtgctctccatgagctgcttttggcggtgccnttggtgcctctggcataccgttttcttggctggagacaacgtctgaagtcatttccattccttggttcaaatcaccatttgatttagcanaatgaggaacttcatctttatttttcttggttgccatcanatatnatggtttgcccaangagcatgagcggnatacagcagagcccaattaacacaaatattttttgaatttgctgttgtccttcanacataaattcatcncaatgttctgctggngatccttgcttgaataacatcatgttnatgaatcagnatcaaaactgatggtgngcagcatggttcanatctgatgtccgtactatttgcagagt

SEQ ID NO: 509 - DNA, 498 bp, Ctenocephalides felis
acactgtcagtaatattgataaaagtggtgagcaagacggaaataatgtgcagcctactgacattgcagatgacttaaactgtgttgatgtggatagtgttgacactgaaacttactcgaaatgcgacaaaaacattaaacttattgataaaccactcaagaagcaaattgtagttttatcagaaaatgattttgatgacggctgtccaaaatcgaatactaataataataacgaccccaaagaaatttcttctcatatttgctaccttcaagatagcgattttaataccagatcagatttaagtcggatcatgactccgaaacatatttcaacaccagaaataccaaagtctaacgcaaataattatgcgactttagatcagagtttccatttaggtcaaaacgttcaaaatgcgcaaattaacaaaaataaatacatttatatcgatcctaataaaattgaacaagattttaacagcaatttaaataatttaaaca

SEQ ID NO: 510 - DNA, 500 bp, Ctenocephalides felis
ttttttttttttttttttttttttttttgttttagatggttgncctcgggtcaaaanngacgtaatgacttctgacatttctggcatatcagacatctttgngaagctgctgagttgctccatttcctttttagtttcaggatcattcatcattttcggtaaaaccatgattaataataatggcaacaccatcattaaaatcataggattgaataggaaatcagnaattttccattggtcccttacttgaaaatatctgaattttcctaatgnctttaatcttaaagggtatggcacttgtatgacttgagatgtttgtatgtgattcactttgcgtgctctgaattttcctttagagntaatttctactctaacaggctcatacatataatttgagttaactgcttccaatacgtaagatccagatggaacattacttataacaaaggngccgtcttctttnaaaaaccctctatataagcccccgttcaccaatattt

SEQ ID NO: 511 - DNA, 208 bp, Ctenocephalides felis
tttttttttttttttttttttcgctttataaacattaatatatttgaaaaatgatatttacataaaatgatttctctcaatgaaatttaaaaatttcttaatcgttttaaaaaaataaatttatgaatcccatttcttatactccattccatctggnggacgaacctcaaccttctctttgcccacctcgttccaatttgngctaagt

SEQ ID NO: 512 - DNA, 355 bp, Ctenocephalides felis
tcaatatggttcaccttaataacattatctcaatatcactttatgttctatttaagcaggcctttaccaaatattttagctctgccacttgtcttattagcagttaaccattggttgaatagtaaagaaaaatattttatcatttattcggcatctgcaatattaatatttcgggctgagttagctcttctactgggattatttctgctatatgatcttattcaaggaagagttcagattttaagattaattaaaatatgcttgccaacagcagctattttaatcacattgactgtattagttgattcattattctggggacgactagtgtggccggaagcagaagttttgtggt

SEQ ID NO: 513 - DNA, 518 bp, Ctenocephalides felis
aattttggtaatactttgaaatatattcttaaattaaattctttaacatatacataccactttattaatggagttttatttggcatgctaattcttccattaccttggtgattcattatgtgttagattggcgcctgtatttattaggacgaagaaaattgaacatgccattccttctattattttttatggcatttggtgtggtattgtcactaccatttggtgtatctgaagtttctcttgtgtcagacaaatgcaacaaagtcgcacgacctccatctaaacgactaggcccccaacctgaagtgtatgcatattcaccagtatgccttcgcagactgtcattagcatgtgatccatttgctgaaaggctgtttggttgagacctatgccctgcatccatttcatcatgagaaattgtattccgatgataatcagggtttgttgatgttctaattggcacaggtggaggcggtggtctaacgctgacagtgacagtatttgaatactggggtggt

SEQ ID NO: 514 - DNA, 382 bp, Ctenocephalides felis
ttccggatttttggtcaatactttagctagacgttctgcaggaatgccgtatcttctcaaatttgcatcncttaaaactacgacaattgcctcatcacaatcttctttagccagggtatcaatagctatatttgttgcgtctaatgtatgatccccagaccaacaaaattgagcatgtgcgtgcatcatttttattgtttccaatctagctttttcatttttaggtggtcttgaatgattaacaaattctagagcatctgcttcaccgctgtgaccaaatatatcatactggaatctatcttcgtgaccctcaaaactttccatcagaagaactactgcttctaattgctatctaagcgtccatcatatccattaaatctgt

SEQ ID NO: 515 - DNA, 489 bp, Ctenocephalides felis
tcaaattagaggagggaaaccggcaacagcttgaagagaacacaattccttgntgcctctaaagtgcagtcaactttagctacgttaatgntagttgaaccgacaacctttttagctaagtcatcccaagtaggtgctaaccttttacaatgtccacaccatggtgcaaaaaacttgacaaaagtcacaccctttgaaatgccttgttcaaagtttgatcccacaagattaaagacaccttcttcttcattagtgnctggaatgcgantatcatctctatcttcatcatcaatttgtgaagcaccatgtttcttctcaacataagcctttaattcttcgtgattcctttgccagagtatttttccacctttttccatcttcaatccataataaagtaggataaccttttacttcaaattgtgtgcaaatcgggcggnggtgagtgcagtcaattttagtaatgcttacagagtcttcatgttcaaaagt

SEQ ID NO: 516 - DNA, 309 bp, Ctenocephalides felis
ttttttttttttttttttttttttttttttttaatgatttaattaatttattntaagccaataattgatattaattatgcattaatcattgnatttatactttcctagaaaactatacatcacatgttgaaacaaattaaggttcatggcttctcgcctttccttagcgcttgttttaaatttgatccattctttccgaatcttgttactntttggtccccatttntcattgggagtgaacacgtttttcaatgtatcattaatggaatgttttctatttttcaaatatatccaaattgcccaaagngg

SEQ ID NO: 517 - DNA, 215 bp, Ctenocephalides felis
atctacaacagcaccgataacggcaacaactttnccttgggcacctgctgctgctttggcagcataactcctgctgttcgataaaatcgatgcgattttacccgattctgttttgctcagggttcgcaaagtggaattgattacggagtgcatcttgtaataaaatgtatagccagttgagttgaattaaattgatctcacctgtaagctactgt

SEQ ID NO: 518 - DNA, 275 bp, Ctenocephalides felis
agcaaaacgtttccataactaggatatcctacttgaaagtgatggctattgttggtacttattgcatttggtccaaaaatctcaggcttataatattggcccacagaagaatatcctggcctgtactgagaaaatgcgtaaggtggtggatggtaatcacagttcgcccattggacaatcgagatggccaccaaaaatattacagctttcattttagtcacttggtgaaatatcacgaattgaaatatttcaaccttcgcaaaaggagcttgtga

SEQ ID NO: 519 - DNA, 498 bp, Ctenocephalides felis
agtattagcatcagcccggacaacaacgcagtaggatgttagcaacattattcaaggatgaaaggtgtcaacatctaccagcatattcaattttggagaaaatgtatttagatcaaataattcgcagatctgacttgcaggagtttgaagcgcttttacagcctcatcaaaaggcatctactntggatgggtcatnaattctggatcgngctgngtttggacataatttgntttctggcagcaaattgtataataatataacttttgaagaggtaggatctttanttggaatnttagntngcaaagnngnnaaaattnccgccaatgntattaaaagggngaatgnatggggcntnaatnanattgntnacattggccttgggcgcgaaccccttaggcgaattttnggatattcantacactgggggcggttgngntntgttttaggggccaattcncttatnggngnngtttaaatactngcgggggttacaannn

SEQ ID NO: 520 - DNA, 498 bp, Ctenocephalides felis
atattttgtatagtttcttttgttgaatacttcatcaatatattaatataatttaggtttcctctcgcaagttcctgtgtcgcagctttgagtagcttggttaaatactgttccaatcggacattgatcaggaactggctctcctttaggacgtaaacacgtgaagaacttccggcatgttgcgtcgttcttgaaagcaaattttccacgtgctcggcattgcccgacacaggtttcgctccttggggaaaactcggcgggttcttcgcattgcaatacggttcctcttccggccatacatacgacgtacaatgatttatcaccaatgtacggaagcaccttaggctgtgcaggacatgtaactgtatagcattttgtgcccagagccataggtccgcaattatgacgtaacggatcatatgcaaaatttgcggggcaataatattgggttcctatactattttcgtcacaataataatagctttgacaatcatttat

SEQ ID NO: 521 - DNA, 500 bp, Ctenocephalides felis
ataacaatantttgagacagcaaactgaatcctgtatngattttctttgtccttggtgcagtctgaattgcggattattatattcgctactgaaacatttgaaactgtgccatgctagatttacctttacatatgtgccattaacacaatgtgctagaatagatgtagctataaacgagttgtatgatggttcttatgttggggcacctcaagatttgctaggcccttctggatttgcattttcagggaatggaccgactcgaagaactattgttacacatatattagtttgccgaccaagaagaagtaaacccagtttatcagaattcttggaattggatgaaaatgaatgcgacagccaaagaccttacattacaggtcacaatcgctgtatcatcatacaataacatgcctaccgattcagctaaagaactagatgttgattcagaangagaaagtgatcctttgtggttaagnaaaagacaatgtgatgatagacg

SEQ ID NO: 522 - DNA, 312 bp, Ctenocephalides felis
tngaaaacttttttaggcccncaannngagcggncgccgggcagggaccaggatattcatccatagcagctttcaagtattcttcaagatctttttcaaatggtgtattttcaataataggcacacacaattcttcatcatatcttaaatttctttttagtgaatagctataaataccctttatcatttctaaatgagtgcatttaaaaacttttcaggacattttaatgtaactaaaactgcagcagaagaatgtgtatgtattacagcacccgcattatggtttctgtatgcaagcataaataatggtgt

SEQ ID NO: 523 - DNA, 258 bp, Ctenocephalides felis
atgaacgtatattatattgagtggcaataatttaattcatgcaaatcataatgataaatttgtaattgtttagtttcaagaaattgtaatattgtaattcatgtaaataattgattgcattccaaaatgtttttatttttgtttttattttaatagttttatttaaaatgttgttgttgtattatatattcagtattttaaaaaataataaatttactcccgttgctaaaaaaaaaaaaaaaaaaaaaaaaaaaaaaa

SEQ ID NO: 524 - DNA, 204 bp, Ctenocephalides felis
cagttaatgatctacaacttgttcaaaaagccttaactgatggatcgaacgcgtgtggaagttcaatcgaatccttcctaaatgttattgaaactgaagaagcacctccaacctttaatagaactaacaaattcactcaaggtttccaaaacttgatagatgcctacggagttgctagttacagagaagtaaatccagctctgt

SEQ ID NO: 525 - DNA, 500 bp, Ctenocephalides felis
ttttttttttttttttttaattgataaattttatttaaaacttgcaaaaattatttaaacaatttacgcatagcacatttcgctcgtgcaaatctcttcctcgcattccagacaagtttccttatcgcatttgtaggtgtcggtgcagcctctcttcactttatctccgtcaatatctaagtagcatttgcccatgcatttggtcttcgtctcgactttttcagggtcgtcaaggcaattttcatcattttcatcacaagaaacacattcgtgttttttggcatcaccattgcattcgtttttgtcacaagttgggcaacgttctggttttttctcgcacatttttttcagattctggttcttgaacaggttgctggtgcaccctaattttatggcatcaccttgtgcatttaaaatactcaaacaagtatcttgnggcttgagacaaacttccttggcatcatctttagcgttgcaaaccctgcgattcttgggaaaac

SEQ ID NO: 526 - DNA, 259 bp, Ctenocephalides felis
cagcagctccagcggctgcagcggctccagcagccgcaattccgccagcggcgttggctccaccaccggcgccccatgctccaccacctgctccgctaccagctcctcccgctccagcgcctgctccgccagcacttctcgcagaacgggcgagagtatctccagccgcctgttgggaactgaacgattgagcattacttccgccatatcctgaagaaccatatgcggatcctactggaggcacatatgcggtgttagt

SEQ ID NO: 527 - DNA, 549 bp, Ctenocephalides felis
tgancgcccgcagaaaaccgttcgacgcgataatctgttaactggcggtgaattttacggtcaaaaagattcaaggtatggtaatttttctaattgtgaacaaagtctaagaagtaccaaagttgaacatacaaggcggtcttctaatatttctcatatttcgtttggagaaggttcttttatatcatctacaacttacaataagcataggggcccttgcccagctgctttattggaaactaataaagcaccatttaaatatacacgtcaagtgaaggcgcataaattttatgtgcctaaagttgtcacggaaaaataggaagcctttaaaatatcattcagaatttatttacttatcaatgtcttccattactgtatatacttatatatatatatatatatatatatatatatatatatatatatatatatatatatnnnatanaggtnacaaatatnncgcnnatnngagagngcgcgcgcnnatattgtntcntacncnnatatnttgngntatanaganntntatatatntggcacnttatatgc

SEQ ID NO: 528 - DNA, 549 bp, Ctenocephalides felis
agataattgtaacccagtttttgatgaatcattcgaatacataatttctcaaggagaattgtcgacgacgcaattggaagtgacggtagctacgcagaaaggatttttatcgggaggtagtcctgtgatcggtcaagtgattttagatctgaacgattacgatttatctcaagcttcaacccattggctggatctatgcccagaatttaagtcataaatgtggatcattgctttcgaatttcaatcaaaacatgcgtatgctattaaattaaatgtgtaattctacctttaatttttgctcctacagtttaaatttacgtttgttatttttaggtataaatatacgctttattttgttattttataaattatcaatatttaataatgcttttatattacaaataatacttatgtgttgcacaaatttggtatatagatgtatatactgtactaatatttattttttcaacataaatttcttttgcatgtgccttacattctagatattcaattatcttaataagtcttaatcttaaacttattatgcgc

SEQ ID NO: 529 - DNA, 441 bp, Ctenocephalides felis
cagttaaataataaggagaagatggattacaataaagcacaaccacttcaccagcaatcacaatttggtggaagacctcaaactcaacaaccaggaccactcagagcgagtgcaatgcaatcaaaagcactcctgcaagttccattctcacctgcaaacagttgtccaaattgtggtgtcggcttcgtcactgacaattactcctgctgcgcggtctgcctaggagcatgctgctttcctctgggacttctgtgctgctgggaatgaaggagagatcctgcgtcaactgtggagcagcttttaactaggatatagagaaaattatgatttaatgtctttgtaactgtcatttttattacttgattttaaatattagatcagatgtttcattttatgaaatacaaaaaatatatattaagaagaaaaaaaaaaaaaaaaaaa

SEQ ID NO: 530 - DNA, 549 bp, Ctenocephalides felis
gtttggcctttgtctttcaaaatattaattttccaaaaacatataccaaacgtatttgcacaaaatttattgtacgttttagaatagtatataaaattcatgtgtccataaaatattataaataagtaaatttccaagttttcacacaaattattgagtaagccgaagcctctttaatgcgccattgcgttttaattatagtgttttaaacagcaaaaatcttgattctacatcattaaaatgagcttcaacgataaacagtcgaattcattcccaaaagatgaatgtgcaaatcgattagaaggattgcatgtacagagatctgacatgaataaattgataatgaattatcttgtcacagaaggctttaaagaggccgctgaaaagttccaaatagaggccggtgtaggtacttcgatggagttaaattctttagacgatagaatattaataagggatgcatacagtctggacgtatcaagaagctcagtattagtaatcagcttatnccgagttgtggatacgcagnatcttattcattgcacactc

SEQ ID NO: 531 - DNA, 550 bp, Ctenocephalides felis
tattcatttataaataaagaaatatgtctttgccagagccacttcaaaagttgttcagccacatcgaccagaataagaaaaggtacattgatgtattatctgaagctgtagcaatcaaatcagtgtcggcatgggcagacagtcgacaagaagttgttaaaatggttaaatgggctgaacaacgattgaaggctctcggcgcaaccacagaattagcagatgttggaaaacaaactcttccagacggcagagttattgacttacctccagtattgctgggtcagttgggaaatgatcctaaaaaacatatggtatgtttgtatggacatttagatgttcagccagctctgaaagaagatggttgggatactgaaccatttgtattgactgagaaagatggaaaattatttggtagaggagctagtgatgacaagggtccgttatcggtggattcatgcaattgaggcttatcaacagactgacaagatttaccagttaacatcaaattgttttgaaggctggaggaatctgtagtgaaggatagatgatt

SEQ ID NO: 532 - DNA, 550 bp, Ctenocephalides felis
gtcaaacgtgacaatgacatcatacatagatgatttttacctggcagaagccaaaaaagaaattggaaatgatctatacaaagagaaaaattatcatggagccctacaacaatattcaaaagccatcgtcctatatccagattcttcatcttactatggaaacagagccgcctgttatatgatgctttttcaatataaaaatgctatggaagatgcaaaaaaagcagttgtgctcgatccaaattttgctaaagcatatcttcgcattgcaaaatgcagcatattggtagatcaccggngcaaataactaacctgaagnggaatntgcattaaggcaagtggnttaaattggccttgccncctttanantattnccnttgtaaccaagaanagaaaatttggggggttnttttggcntnttttttggggnaanaccacgtttccccaaaaatacccctttataatttntgtngnggtngnaaaaaancccccccccccttccccggtttttccccggngttttttgggnctcccgaaaaaaagggggggc

SEQ ID NO: 533 - DNA, 549 bp, Ctenocephalides felis
gtttcacattcagtcgatctgtgagtttaatctgtaaacatctgtttcatcaaaaagtttcagcgaaattaaaataatggcaaatggaatgccggagttgggctccaagataagcctcatatcgaaagcagatatcagatatgagggtcgccttttcactgttgatcctcatgaatgtacaattgcattagcaaccgtacgttcatttggaaccgaagatcgagataccccgtttccagttgcaccgcaaacgcaaatatatgattatattttgttccgcggatctgatatcaaggacataagagttgtcaacaatgtcaataatcctgtgcccaatgaccctgcaattatgcagttatcggtgcctccaagccttggccaacctacttatcaacaacccggatatacccatccagttcttggagctgtatggggcaatttggaggtgcttatggaatggnggttgccacaaagtatgccgctggatggcaatagaccagtggcaaacaataaatgagttgcgcgggaggatggcagctatcacacaga

SEQ ID NO: 534 - DNA, 549 bp, Ctenocephalides felis
ctncgaagtgctcttactatatttgttatagggnatatatatttaagtatattgaagaattgaaccgatggcaagcccagttgtgcgaaaatcgaacaaggacgaagtaaataaagaaattgtcagtatggatgaagtagctaaagatgctaaaaattttattgaacgcattcttgggggatgtgagcaaaacctcagcaactaaacaattagtcattggttcattatcaggatggacaactggatttgttactatgaggattggtaaattggctgctcttgccgttggcggtggtattttaatattacaagtagctaaccacaaagggtacatttctattgactgggataaagtaactaaaaaggctgataaggtgacagataaaattgaagaggctgttactggagaaactcctaaattaatggataaaattgagagatttgttgataggaaaattgacaaagcagaggaattgctaaagaaaaatcaaagaaaagccaaaaaatggatcacggcttcaggtgaagaagaattaaattgcaagaaat

SEQ ID NO: 535 - DNA, 549 bp, Ctenocephalides felis
gcagctctaacagaagcaaatgatcagaaaagnagtaaaaaacaaaccttaagcagcctaagagcacaaatgggtttactaattagtcgaaaagattcacctgtagcagtctcaaagcctcctgtattcagccagagtggtaatgttagcaacacgacaccacaaaccacagttcctggatctaacatacattcagcacaagttaggaggagctctagactttttacaaataattactcagttaaagaaaataataaatctccaaatagaaataaatttgccaccccaaaatctcctagaaaaccaaagcaacgtttaacaaagactaatttaggtaaaacaaattacgaaataactgaaaaaacagtagataaagaaaaagtagaaactataacgtctgatcaaaaagttttgctgaataatagtataaactctgacaaacatcagcgcagcaactttagttttgcaaaacaagtgtgatggactctgttcttttaagacagtaggcaagcttantatgttaacccaattcgtgcnaagantgtgtgt

SEQ ID NO: 536 - DNA, 409 bp, Ctenocephalides felis
cataatcatactttggatctaaaactaactctgtgttatttagaactgtagactcattataattaatgctccaaccactgccgaaaatatttatcgatattgagaaaatatcattataaataaatccggtatacatggagaaaatgcccatcaacaacataatatagcgtccagaaaaaaatatgttccacgtgtcatcagttatgtttttggctattaattttttctcgttgatcaccaaaacagcggcaaatattaaaattataagaccatgaccaatgtcgccgaacatgactccgaataaaaatgggaaggtgatgatggtgtatagtgcagggtttgcttctctatagctggctatgccataagaattgatgagattctggaagccctgagtgaatttatttgt

SEQ ID NO: 537 - DNA, 166 bp, Ctenocephalides felis
atagctgatcctgacatacgttcagctgttacgacaggaccagaaacggcgtatacatagccgaattttccctctcgctcttcatccgagattttattaagttcttgaggcattttggctcctttggttatttgtcgttttaaaacacactctgatcctgttcgaa

SEQ ID NO: 538 - DNA, 135 bp, Ctenocephalides felis
tgantgcgggtgctctggaggaaccaaaaacctactcactttataagggcttcatacatctcggcgctggtttggccgtaggattttccggcttggcggcgggttttgcgattggaatcgttggtgatgctggag

SEQ ID NO: 539 - DNA, 79 bp, Ctenocephalides felis
tgatgattatgaacaagttaaagctgtagctgaatattatgctgagtattctgctttattcgaaggctctggcgatggt

SEQ ID NO: 540 - DNA, 140 bp, Ctenocephalides felis
gtaggggcacaaattccacgaagtttttgtcatagaagtcatccaaagcacgcatatatttactgtatgaaatcaaccaattgattgaanggaaatgtttcctttgagctaatttcntatccaaaccccanaacacttgt

SEQ ID NO: 541 - DNA, 462 bp, Ctenocephalides felis
ttttgatgtcatataaatgccancaattaaaccaantagaccaatagcagaaccaaagatttcaacaatgagaattttgacaaatagtgcagaattggcagcatcagcaagagctgctccagatccaacaataccaacagcgataccgcagaataaattcacaagaccaacagccaaaccagctccaaaaagaacataaccacccatccaatttgcttctttatatcctgctttttcaaaaacagatttgtctgtgtattccgctaacagtcctgacagaacaattgctgtaattaaaccataaatagcaacagcttcacagaaaataactgaaattaagttttttgttttgattctgggcgctttcacaccacctcctacaatggatgtgcctgtggtatgaattccaacaagctgctccaacanctganaatgctacggntaaacaattcctaagggagc

SEQ ID NO: 542 - DNA, 396 bp, Ctenocephalides felis
aattggttggtaaagcctccttgggcggaaactgacaagatcacacttgaanttgccaagctcttgaaagacgatttcctacagcagaacagctactcatcatatgatcgtttctgccccttctataaaacagttggtatgttacgtaacattattgctttctatgatatggcaaaatacgcagttgaatctactgcacaaagtgaaaacaagattacctggaataccattagagatgctatgggcaatattctatatcagttgtcctcaatgaagttcaaggacccagtcaaggatggtgaggcaaagatcaagagtgattttgatcaattacatgaggatttacagcaagcattccgcaacttggnagattagattattgtgaatataatatgt

SEQ ID NO: 543 - DNA, 283 bp, Ctenocephalides felis
anacactttgtctttgttaatttctgtttctacgtagcggagctttctctccatctcatcacaacgcctgacttcgttgacgaatttacgttgaaatgaattaacatcaacattcaagtctctaaattggacggttccagcttctcccaattctgaaactgaagtgtaagcagcttcaggctgaataaacatctggcataaagccatctcctcacttcgaaacatagcccccatgatgtggcctattcaacacccgctccttgatacaaaataagcgggttgc

SEQ ID NO: 544 - DNA, 346 bp, Ctenocephalides felis
gacattttagaactttcaacaaagatatgttcaacacaacaacagactatgtaaaaactgtatacatatataatggaatattttttgtatcataattaaattgtaaatctcatgatttactaagcgttgacattaacagtattagcagcagctcctttagtttcactggtttggtccttctcgagttgcttgccaaggtattcccaattatgaaccattaatttctggactgccaacaaagcttcatatcttacatttggttcctcatatgccaataattgcataaccagttgtttgccaccaagctgttcgatgatatttttgccacgtggataatgcctgacgt

SEQ ID NO: 545 - DNA, 498 bp, Ctenocephalides felis
atgtaacctgggaaaccacgacgtccgggtacttcttcacgggcagctgatacctcacgcaaagcttcagcatatgaggacatgtctgttaagattaccaacacgtgcttttcacattggtaggccaagaattcagcagctgtcaaagccagacgtggggtaatgatacgttcaatagttggatcattggccaagttcaagaacaggcacacattctccatggaaccattctcctcgaaatcttgtttgaagaatctggcagtttccatgttgacacccatagcggcgaacacaatggcaaagttatcctcatggtcatccaaaactgattttcctgggattttaactaaacctgcttgcctacagatctgggcagcaatttcattgtggggcagaccagctgcagagaaaataggaatcttctgtccacgagcaatggagttcatcacatcaatagcagagataccagtttggatatttcctcangatagatacgag

SEQ ID NO: 546 - DNA, 393 bp, Ctenocephalides felis
tctccaatatcaaagcaggctacagacagaacaaggggatcacgagagctttcaagtaagnggatcaanatacgcaataactcataattcttctcattgagacgtggggcattctctctccagaacttagcagatttgtgaacaggtgaccattccaatctgccggacttgatttctgtagcatattcatcaaatgagctaaggtcttgaatggaagcttgtaatttttcggtcaaatattcaacatcagcaacgatatcctcatcatctgaacgtctttgttccaggatggataattgtttcaataccttgctttgcaccattgcaatgcaatgctccttggccacctgttgatcttccactttctcaattaaattcctataaacagccagt

SEQ ID NO: 547 - DNA, 649 bp, Ctenocephalides felis
cgagtacaaggaatgttccagcttatggagcccaaagtattattgaaggtccgcaaagctgatttagatttggtagaatcagttttaactgatgccatggatcagtataaacaacagatggttaccaaagaagttgtcgccactatcaatagggaagcatttttgccagtagaatgctgcggtggagttgaattgagtggacttaatggccgcattaaggtttcaaacacattggaatcccgtttggacttgattgctcaacaattgattccagaaatccgaactgccttattcggaagcaatgccaaccgtaaattcacagactaaatattcatatcaaattacatgattaggatgcaaagtgacctagattcgtattagtaaaaagcatcaagatcaaaatgaatgcacaatcagattcataatgagtgtttttgcatgatacacattttttcagacaatagttcatataattgatgcttccctttgcttcatagtcctatttcaaaaatgttaatagatgcacattccgtagaagttatatagcatgctataattgaatgatgaatattacatttgaaaattttgaatacttaattggnctaaatcataattttctgaaacatgcattttattcaacacttttgct

SEQ ID NO: 548 - DNA, 360 bp, Ctenocephalides felis
tgctcttgtcgcaaacacatctaacatgcctgtcgccgctcgtgaagcttccatttacaccggtatcaccctcagtgaatacttccgtgatatgggttacaacgtatctatgatggctgatttcacttctcgttgggctgaagctttgagagaaatttcaggtcgtttggctgaaatgcctgccgattccggttatccagcgtacttgggagctaggttggcctctttctacgaacgtgctggtcgtgtaaaatgtttgggtaatcccgaacgtgaaggctcagtatcaattgtaggagctgtatcaccgcccggtggtgacttctcagatcccgtcacttcagctacattgggtattgt

SEQ ID NO: 549 - DNA, 357 bp, Ctenocephalides felis
ggattcattcgatcagcttcatcatcatatacatatatatgttttttgngngngatttaataattggcttaaattttacatcttgnttgttttaaactttgttgncaaccatatcgacgttcagtttatagtagacatatggatagtaatcaagcttggccaaaacccanaccaggaatatcaacgttctcagaagcaccggagctttgtagagcactgctgtcaagtgtccgtacaattgattgagcacatctcgtaatctcttgatgctcttcttagatggttgaaggcaacttcagtgaatgcttctgtgcatggatccatgttaaggcgctacgagttttcgttgagtcaagt

SEQ ID NO: 550 - DNA, 500 bp, Ctenocephalides felis
cactnatttggcccaatttatgaacgtgctngacgtgttgaaggcagaaatggttctatcacccaaattccaattttgactatgcccaacgatgatattactcaccctattcctgatttgactggttacatcactgaaggacagatctacgtagacagacaactgcacaacaggcaaatctacccacctgtaaacgtattgncttccctgtcacgtttgatgaaatntgccattggtgagggtttgacacgnagagancactctgatgtgtccaatcaattgtatgcttgctncgccnttggtaaggacgtgcaggctatgaaggctgtcgtangagaggaagctttgacacctgatgacttgttgnacttggaattcttgcgaaatttgagaagaactttatctcacanggtanttatgagaaccgcacagantttgaatctttggacattngctggcaantggtgggatcttcccnaggagatgttgaagagaatacc

SEQ ID NO: 551 - DNA, 116 bp, Ctenocephalides felis
ccatgtcagtggccaaagttggttgataacctacagcggatggaatacgacccaacagagcagatacttcagaaccggcttgagtgaaacggaaaatgttgtcaatgaaaagaagt

SEQ ID NO: 552 - DNA, 294 bp, Ctenocephalides felis
caaaggctatcaaaaaatgtcttttctaacaagtgtttacatatttgctttgtatcgaatactatttaaaaaatatttattatacatgcatcaatgatacatattttaaatttacaatacttaatacttttagtaaggtcactatgatttgttgaataatttaaataattcaaaatccattacaaataataaatactgctaaacaattagcaacatactgtatggataatacataaaattactcggagttcaaaaaaaaaaatnaaaaaaaaaaacaaaaaaataatcatgagt

SEQ ID NO: 553 - DNA, 436 bp, Ctenocephalides felis
tttgcgtctntgggccctgtcacttgctcacgcacaactttcanacgtattgnggaaaatggtgntgnccatgggattgagccaaacaacatatactggctcgattatgctctatgtgatattctgcgngngggcactattcacaattgccatcctagttatgatggaaggcctttctgcgtcttgcacacactgcgtcttcactgggtggagttcatgagtaagttctactctggtttgggttatttgntccaacccttctgcttcaaaactattttggacgcggnggataaggnagcagaataatcaatttatctattatttaaataaattaaaaaacaaattagttataaagaaggtataaaaaagnaaaatattggntaaaaattgnttttaaaagnctgnaagngatttggaataacacttaatttgtagg

SEQ ID NO: 554 - DNA, 223 bp, Ctenocephalides felis
aataagtgttgttaaaacttctttgtattgttccttattacgtgtaacttctcccaaccttttgcgggcttcatccaaaacattcctcacatgatcttcacgaactttcaataccttcaatcgagcttggttgagcatgttggatgattgaattttcttttgcaattcaacttgtttttccttcttctcatagtattccataatctttagtcgctgttgctgt

SEQ ID NO: 555 - DNA, 418 bp, Ctenocephalides felis
aattcggtaatactaggaatgtanaacanaaatataatagaacaataattcgatttcaacaaagatattgtattttaattttaatttatattgatcacaaattaataactcgttacattgtaataatactaaacaatctatttacaattaaaaacactcctttcgcaaactttaattctccttcttgatgcgtgtggatgtcattctgtaaataatggagtccctgccagggtccattgtggagatcgagatacagatagcaagtaacgagaagaaaaaggctactccgaaccataaaatgatgttaaaaaccaccgggtaggagtcgttgtattctttagctaggttgaaatcgggttcttttggagcatcatctgcttgccttgcttacgtgttaagacgtcattagagggttagt

SEQ ID NO: 556 - DNA, 289 bp, Ctenocephalides felis
cgtagcccagaccagtaactgagaaattacccgcaaaccacccattgttnactgggcaacgtgtnttggattctctgttcccatgtgttcagggaggaaccactgccatccctggagctttcggttgtggaaaaactgtnatttcacaagctttgccaaatactctaactctgatgtcatcatttatgttggttgcggagaaagaggtaatgaaatgtctgaagtacttcgtgatttccctgaattgagtgttgaaatcgacggcgtaactgaatctattatgaagcgt

SEQ ID NO: 557 - DNA, 549 bp, Ctenocephalides felis
caaatcctttgacattagataaacgtagtactatttaagcacaaaaaggtataatataataaaatggctagccagactcagggaattcaacaacttcttgccgctgagaaaagggctgctgaaaaagtctccgaggccaggaaacgcaaagcacgcagactaaagcaagctaaggaagaagctcaagatgaaattgagaaatatcgtcaggaacgtgagaagcaattcaaagaatttgaagcaaagcatatgggctcacgggaaggagttgcggctagaattgatgctgacactcgtgtcaaaatcgatcagatgaacaaagctgtatctgttcaaaaggatcccgtgatgtatgaaattctgaagttggtctatgacatcaaaccagaattacacaaaaattatcgcaaagaataatttattttattcagagctccagtgaaaaaataatatatttaataaagattgtttatatccacatttttgcttatgtgaaaaaatcttaatagatcaatctgattttagaaatctagaattttaantagggtc

SEQ ID NO: 558 - DNA, 550 bp, Ctenocephalides felis
ttttgattgttattactttattttaacaaaataccgtgaaaatcatttggtataattaataaagaaccacatcaaaatgacagagtattggctgatatctgcaccaggtgacaagacctgccagcagacatgggagacgatgaacaatgtcaccagcaaacaaaattcattatctgtcaactacaaatttcatataccagaccttaaggtcggtacattagatcagctcgtaggtctgtctgatgatctaggcaagctcgatgtattcgttgagcagatcactcgtaaggtagcaacatatcttggtgaggttcttgaggaccaacgtgataaacttcacgagaatttaatggcaaacaacagcgatctgcatcttacataactcgcttccagtgggacatggcaagtacccaatcaagcaatctcttcgtaacatctcagatatcatcagcaagcaagtaggacagatcgatgccgcttgaaaaccaaatctcagcgtacacaattgaaaggagtttgcagacttggagaagaacaaactggaanttgt

SEQ ID NO: 559 - DNA, 371 bp, Ctenocephalides felis
tggtattgggagaattaatttgtgtttttaaaaaagttcgtcttttttgaataactgaatgaatgagattttttgggtaacaattttcaattagagttatttttactagggataaattttgtggatggaaagtttggtgagacaacaaaatagcatggtctgtaagggaaataatagtgtttatcttatagtttctgggacagtatgaggaatagtgtaagtatctacccgaccatgtagtttttctataccaatttgttcgaataaagttattagtgttgtaaacggatacatccaagaaattaagcctgttgttattttgtagttcatgtgtgaaaattatattattgttaaaattattgaagagatct

SEQ ID NO: 560 - DNA, 228 bp, Ctenocephalides felis
ctcgtaaatcacttggtcaccagtttgatttgtggtagtctcattttctataggnataaacatcagntggttcattgaaagggttgtttgggtgcttgtcggcttcgtcgaagggattggtgcttgtttcgggttctggttcgtcgaaaggatttgctggaacgtcttgcttggcgtaactggtgtccccgtagacttgtttcgaagattcaccaattgttttgacgt

SEQ ID NO: 561 - DNA, 269 bp, Ctenocephalides felis
agatctactaatgccgcgtttaccactgtcacagcaattccgcaaaccagcaaccacanatataantatgatgctattgttaaatgntcaataaatgcacaaattattccacaaatnccgcatgagaccatcacgaatacaagaattggaagctttcccacagagttaataatagcacctattatgggaaatccaatcgcatatccagcttccaacattaaagaatgcataaatgcctgttcttccattgtgtctttacactcggtcgt

SEQ ID NO: 562 - DNA, 500 bp, Ctenocephalides felis
aaaaatccaacggatgtttcgtcatacagacctatcagtttgcttcctataatttccaaaatactggaaaanataatatacaaaaaaattaatcatgatttaccgacagacatctggatgccgtcacatcagttcgggttcaggcataagcactcaacgactcaacagatccataggattgttgaaaatattaaaaaaacatttgaacaaaaggaatattgcagtggcattttcttggacgttcgtcaggcctttgataaggtctggcatcctgggctgttatataaaattaaaaaacactttccagttaaatacttcaagttattaaaatcttatttagaaaacagatctttccagattagagtgaacgctgaactgtcagatttctgtaaaatagggtcaggtgtcccgcagggcagcatcctgggaccattattatatgnattatttaccttagatatccaataccttctaactctattatagctacattgcagacg

SEQ ID NO: 563 - DNA, 270 bp, Ctenocephalides felis
anatctactaatgccgcgtttaccactgtcacagcaattccgcaaaccagcaaccacgggatataaatatgatgctattgttaaatgttcaataaatgcacaaattattccacaaatcccgcatgagaccatcacgaatacaagaattggaagctttcccacagagttaataatagcacctattatgggaaatccaatcgcatatccagcttccaacattaaagaatgcataaatgcctgttcttccattgtgtctttacactcggtcgt

SEQ ID NO: 564 - DNA, 210 bp, Ctenocephalides felis
ttttnaagtgcaacccaatcattagggaaccgctaacagaagttatnacagtgacgttctacatcggagaatggttagaattcaaaaaataatcatgcaacacggnctcattattataacattcacataaaaaatatttaaaatatgtaaactagcttgcatgtttattgtaagccagtctataatctattattgnttgcactttactta

SEQ ID NO: 565 - DNA, 425 bp, Ctenocephalides felis
ataagtcatttgaaaataagcatttctgtagtggtgtcttcctggatgttcgacaagcattcgataaggtttggcacccaggacttttatataaaataaaagcatatcttccttcaaggatttttcaagtaaaagtaaatcaagtaacatctgatttccacaaaataatgtcaggagttccacaaggtagtatttttggacctttcttatatgttttatacacaaaggacctcccattacttgaaaatctgacacttgctacattcgctgacgatattgccatactaagtagtaatcacagtgctgatcaagcttcccgacaaacgcaagaacatatcaataaactacaaatgtggcttactaaatggaagatttgcataaatgaaaccaaatcagttcatatcacatttaccctgagagagggt

SEQ ID NO: 566 - DNA, 328 bp, Ctenocephalides felis
gaaggatantttatgtaaattaatggttgatattantttggcnttttcaagaaataattatgtggnggcactcttttgcgatattaaaggggcatatgataatgtcgttccaagtataatgttccaagaattaattaaaataggattaccattccgattggtgtcagccttaacatttaatatatatgaaaggaatataatagtgaagaaagataacaaaatanttggtgaaagagtagtgaataaaggactaccacaaggaggtatacttagcccattattgtatgctatatatgtaagagatatagataatatttgggtaagaggt

SEQ ID NO: 567 - DNA, 284 bp, Ctenocephalides felis
tgaaaacgaaataattgttaaaatgtctgacatagaagaacattatgccataaaattgttaacaaacaatttcaatcgagaaccttcaatagttacaaaatgggctatacctgtatcgttcgcaggtttggcttttgttggaacttgtgtggctaatatgctgactaaaaaaccaatgatgtcaggcattcagaaacacatccttctgacatctagttttggtggagttggttatatcgcagataaatatcgtaatgaatattatgcagaaagagatgctatgt

SEQ ID NO: 568 - DNA, 500 bp, Ctenocephalides felis
accaatgtataaccgttagactgcaacgcggcgtttacgcgctttgatatttcatctctaagcagctaacacaacgtaattgctttgaaaaaagcatttcnaaattttcaacaaaatatttcaaattaaaaaagtcaatttctctcacttttcaaanttttgnaaagctttttnnnaaattannctangggnccnnaagtnntnacaaattngnccgnaaagcnagaagncctgcacccncaanggcactgncnccggtaaaaannggggggctcncanaataattncnntnnncccccagcntnggncaccnacgnnncnngttnnncnntanntntcnctccnncnacnnnntntcgtncnnacnacgcnntanncnccncntcncnnnncccntncaccnnntnncgcncgaccatnnctntnnnaangcccnatnncccctntagnnngccgtntctnacttgntnnncnncntttcnntgancgtntctcggnan

SEQ ID NO: 569 - DNA, 358 bp, Ctenocephalides felis
acaattgtgtagtgcagtggctaactgtattagatgatatagtcaatttaaaattcaggaactaaacttaaattagtattacgttgctgtcttcacattatgttctatgctcatcagttttaagttaaagttggccaccactcatatatagcaaatagataatgactattgcgaaagaagtctagactataaaaatactaatttatttatttatgtagtatatttttagtattgtgagtgaaagacgtttaaaatacatctaattcaaaatagtcaaaatgattctaaccacattttgtatgttttaagtatgcaagcatgtttgcttgagatttgtttaagaacctaattgtttagt

SEQ ID NO: 570 - DNA, 368 bp, Ctenocephalides felis
acgtaatagtctacttctactaggtgttcactcgtcaaaatcacgaattgaactggcggattaggaattgccaaatattttatattttactcgtaacaaatattttttaaattgcaataaaaaaaatcttgtaatttaggctgtaaaacttcattgnttaaatatagaatatgtaatatgatnagttgangttggnatatctataaagttttttttngtttnatgttnncaannatcaatcaangttngcnttttnctgangtatttgaanattttgatacaantattaaaatattttgatttttagtttttttttgcatatatngctgatcaaaatantataattttttaanacantatgctggttg

SEQ ID NO: 571 - DNA, 255 bp, Ctenocephalides felis
acaatgttttacatcattaacattaatttgcattcatcacaatgaacaaaactgatctttcgttcaatcaataacgtaatctagaacaattgtaatgaattacttttattattataagaatccaaacatgtattattccttaaccattttctaaagatctatggcatatttaaacatattaatatattttgatactatttattttcattaaaataagcaaaattggcatattaaaacaatttaaatagttttagt

SEQ ID NO: 572 - DNA, 500 bp, Ctenocephalides felis
accactgtatttcttgaagtcaaaattaatatactcagaaatatcataaaaactgttggcttatttagtaaattaatcaaaacgttgtggaatttatgattgctttgttgtcgtatttgtaaaggtaataaattgaacagttgaatacccaaaccatcaattgaattaaaagtagtattaagcttaaaagtcgatcctctgatagttctattccttgtgacatagtagagactagacatggaagataaattaaaatactggggattattttttataaagagaagtgtaataagtaggaatatgttaggaacggtaagaatattatacttctgaaaaatatttctacaacttgtcatagagttaagagaaaacatgattcttagtgctcttttctgaagcttgaaaacatataatgaaaatatcttctataatatgtatgaaaatcaaatcatattttgntatattcatcatcaaactttctcatattttgcttctttttc

SEQ ID NO: 573 - DNA, 341 bp, Ctenocephalides felis
actgtttaattgtatatgtaacttttactcgttactcttatcacagagtaatcaaattgacaagatgacgcgttcttaattaataaatgatttggacttctattatttattataagttggtaaatccttgaaggcaacacagcaatttgatgatatcggcctccgcctatttttcctcaaatgaataacacaaaaatcctatcgataattaactaacaatagcacggacttataatactaaaacgaattatgatttagttcacattatccttacggataaatgaagtgtttgttacaacttacaataaatgttgtaaagagttgataaagttacaaattgt

SEQ ID NO: 574 - DNA, 359 bp, Ctenocephalides felis
acatatacatatttatgatccttctattagtagattatataattaggtttttgtctttgaactgattatctgcaaataacgtaaattagaaaacgcacaagagaaaatgtttatatgattccgatatttactcactatttatttttcacaaagcatagaattagtttttatatgatgcttgatcaataatggtgtttgaaattttaaaattaatatacgaagctatttaatatcacgcaaagaaactttgatgtttataagacacctatgtttacacatacatacacatatattgtaaatattaatacttctttataaaatccatgcatatttgctttgtcatattcttattattctgt

SEQ ID NO: 575 - DNA, 353 bp, Ctenocephalides felis
acataatatataagttcgttttatattaattgaaatatataaaatattcgaatttaaaattaatgaataattaaaatgttcgtttaaattgatttaagcgtaatggatttagtggatttgtttgattttgatgctctactctgtagtcgcggctggttcggtcttttcggtcttttcgatcttattggtcttatctgtattatcggtcttatccaccaccgattcgagctcaagggctttgagttgaagtggccttttttggatgtaataagataataaatttacatcattacggatttttccactttctgggtagtaagatttcctcttgttgtaggccttgtcgcctgcgt

SEQ ID NO: 576 - DNA, 399 bp, Ctenocephalides felis
acacttgacccaatactgatgtcgtcaaatattcntattgtaaagtcatatataaatcgtcaaacagtttttgagttgtttcaagtattttgttttgatagtctagttcaaaagattttaaacacatcgcccagcaaaatatattgcgttttcttcgtaaaaatcaaatttcgtacacttgactcaataccacacacaaatcattttatttttctgtcttcgaaaacagatattaataggcaaatgttatgtttcagtaatctctagtattttttttcattgacatgtttatatacagattttaaatatattgtgttttttttacaatcccaacgtctctgttatgtctctcagcactcgacaatttttgaacctatcgacggggtgtcgtagtgccgt

SEQ ID NO: 577 - DNA, 1000 bp, Ctenocephalides felis
accgtaattaaatattggaatgattttaattgatttcaaatagattattatgaatattgtaactttcattattcatatttagtagatgaaatgtaagtagcttataaattgaacgacggtctttatacatgtttatatgaaaagtaaataaacaaacctcatagaaatttgataaactgaattgcaaagctcaaattatttatttcaagtatataagcgagctttagaattttcgatagaattaaaattaaaaaatctgatgattttcaatattaaaaanaaagaaaattaaaaagaaagtggaattttgagatgaaaaaaacaatttatttctcaaaaaactaatcgattctaagcattgtcaatgcaagcaatatgtntttttaaatcattggaatttagatgctgcgttttcacaaaaactagattttagcactttttgctcttcatctaccaaacgggtggacctgcctatgcaaaaatctaacaaaaacgtctcgaccgtaattaaatattggaatgattttaattgatttcaaatagattattatgaatattgtaactttcattattcatatttagtagatgaaatgtaagtagcttataaattgaacgacggtctttatacatgtttatatgaaaagtaaataaacaaacctcatagaaatttgataaactgaattgcaaagctcaaattatttatttcaagtatataagcgagctttagaattttcgatagaattaaaattaaaaaatctgatgattttcaatattaaaaanaaagaaaattaaaaagaaagtggaattttgagatgaaaaaaacaatttatttctcaaaaaactaatcgattctaagcattgtcaatgcaagcaatatgtntttttaaatcattggaatttagatgctgcgttttcacaaaaactagattttagcactttttgctcttcatctaccaaacgggtggacctgcctatgcaaaaatctaacaaaaacgtctcg

SEQ ID NO: 578 - DNA, 500 bp, Ctenocephalides felis
acattgagcattcttgacttttcgcatttaaacagctgtancttttaaatttaattattaccaaaaaatantattaacacttttgttaagcgataaacaacaaatccattaatccgtataggaatttattgagacttttcattgaggagctacatccgtttaactaaaaatttgctcaactagctccgccctaccctacttaactttatatntatccctttggaatatattgacaagacgcatttatntgttattatttatgnnttaanctttataactaaatactatgaaataattccatatacattcaaatcattttatttagtttcagtaattatatttgcatataatataangatgtattnntttacttatttanaaattntaangtaaattttagtattnaataaatantgggaggaaatctaggaactaggatgaattttgcaactcataaatatgataaacatttatgaattntgcttatattctaatttgaa

SEQ ID NO: 579 - DNA, 500 bp, Ctenocephalides felis
acaccgtaaagctttcgcttttcggtccgagatacgagacctcgtttcaaaattgaaatatgaatatttcattgtgtgtgagattgaaaaatctgctttcgctgatctttcattttcttaaaacaacgcaatgaagcgaatgttcaaattcgcacaatttgaataaaatgtgcagagtatatagaatactaacgcaagcgtttactacaatcgactttgaaacactagactttcatctagcgcccaaagaattgattgagctatgcgtttaaagtataatattcaaaaagaacgccgttttcacaacgaacttcgtcattcgctcaggcatctggcgataccgagcagatatacatggcagtgctctcacacaatgcataagagcgctaagcggttgtaaaccgcgtcacgctgcttttgcacactgcgcaatattttgcgactagctccggtcaaacgttaatgaaacgaatgatccatcgttgcgagacgctttaaga

SEQ ID NO: 580 - DNA, 277 bp, Ctenocephalides felis
acgagagcgacatgttcgggaacccgtgcgttatacctgctcgagtcctttggttttgagacgtcccattgcatattcataggatattcataggatatcgcgatattaggagattgtgaggacaagtgggacattccctggcatgtcttgtgctgtctgggaaggctgtcaaatgttatttcttcacagattgaatcaataaccgaaactatgacacaccaaaatactaaccgaaagcctgcaaataattttatcgccaattcagataaatatttgt

SEQ ID NO: 581 - DNA, 500 bp, Ctenocephalides felis
acacaaaattagaaaaatttaattaaggatctgcgataaaaaaaaaacaatttttgacacatgaaacaattttctaaatcatttttctatttcatgttcaagagaacagacggacagacgaacagatagataaacaggtggacacttaacacgttaatcgccatgataatatcagaaaaaaatttacatgcactatggtaactttattagttgaaaatgtatcgaaaactccatgtagcaaagaaaaaaagatattttgaaaaattcctgcacattatttttttatgccacatatatatgactgatatatatgtcagacataatttataaactagtcggnttggtatttagccttgaggcaagttacatgaacttcccgatatgtttaaataatcaacttaatcaataaaaaataaattaatttatgagtcattaaaagtattccgagtggatttattatacataattgaaaacgaacgaacactttgactcngagtatt

SEQ ID NO: 582 - DNA, 469 bp, Ctenocephalides felis
acaacggggatttgattccaaccacaacaccaacgcaaacatttttgttctaggcatttttatacaaattgaaatagcacaatttaaaccaaaacgaaacagaacaagtaaaccgcgcaaattatcaaatcactctaccgacgccgacgtcattttgctattctcgggattttagtgtgtcacaaaaaccagatgttgataacaggttgactgccgaccgtagtgttgtgccattagtgtggaaatttataaatatacatatgattcagaatatgagtaacacttggttatatttataacgaagtttattcacagaaaaatatagaattgaatttagaaaataacttttgtatacgaagtgtaagttacggtggttcaaagtagagagagttttgccggtttctcctttccaaacccggcgtcctgggttgccagagcaatcatgtttgttcttccgaagcctcgccgt

SEQ ID NO: 583 - DNA, 500 bp, Ctenocephalides felis
actgactgnatatccattgcgcatttngtataatngaatnttnnnagcaataaactttganggattgaggggtatntcnaatttggncattgattcccattactatgtgatcagtcatttcgtaaattntattttcctnattnttcataaccactatactgtgcgcgtntgtnatgancgnggcnatnataacgaatttgataaaacgnatncctaataaanatttgattttgtacacctaggtcgngancangcnaagacnaataatgcagatgnncatcacagnggggganngannaaangtggatgtagangggtcatntttggcctatagngagtcgtattacaattcantggcngtnagtttaacaacgtcgtgactgggaaaaccntggngatacccaactgaangacttgnagcacatncacctttnnggnaggtngggtaatntncgaagaaggnntgnacngatnggcctnccaacagttgngcannctga

SEQ ID NO: 584 - DNA, 500 bp, Ctenocephalides felis
actgcctttaatagaaaccatagaaagttgagtaatggaaaaatatatggtggtcctatttttcgaatagatgaatgcttctcagtatatacaataaaagtctcttgggcagtagaagcattatttcgacaaagatattgtaaaactgcttgtgttatgaacatatcaatttctccattaaatcctttctctgtatgcaattcaactaacatagaagcaaaaccggacccatccatggagaacataaaatgatatcttgcttgagcataatttttttcttgccaatatgcttgtgccaatttctggaattatgtttatatttaaatatgcaacaaacttttcaaaccttcctctgtcctatatctaattattagcaatccttccataaacctacatactcactttatgcaattcaggatgtccaagtttattatcaccatccttgaccatgttaaggaatttgataaaaatgtctctctctctggcacatagggcccaat

SEQ ID NO: 585 - DNA, 445 bp, Ctenocephalides felis
acatatttacgcgcaacatagcggcactacgcgcaatatncaagccgncagattaaaactgtgattaaactcataataaaactcgatggcacgatcattttatgaaacattaaatatcagttattaaatgaacacttaaacgggaatttcataatgtagataatatgacaaaatcgattttattttgcttctgtttaaattgaatatgcccggtaattgacaggttttaactgataaacggaatagctnctgatcattaatagccaaaattgtgctaccgtaatattatgattcagcttctaatggatnaataataaattatttcgaatggtttcagtgggcggcgtgtaaataatatagttcatcacttgcaatgttagatttatgagaaaatgcattgctttgctcgttaattaaagatttcatttaaatttatatatgtggg

SEQ ID NO: 586 - DNA, 500 bp, Ctenocephalides felis
acaagaaaagagggcgatatagctcaatgtgttaaacgcgccatcgagggtctccgaccaatattcctcgaaggagacaaagctcgaaatataccatcattggaacccctcgaggtgggagatttgctggtgggcgactacggtcgtagcaacggaggtctacggatttctgctacggaaatcatggctaagggcgcctccaatttccgtattgataaaataagcggagatcttgataaactagaattttactttgaagtattactacctcgtcttgagactacaggaaaatatgctgtanatggaaatgtattattattacctattaagggtngtggaccatttactggaaattncactgatagtgtaggaaaagcttgtaatgcanggagaaaattggtcgaaaagatggccaaaacatattaaattcacngatttaaatatcangatcaaagttggaaaaggtcgcttgcttttgaagaattatcngtggtgataaa

SEQ ID NO: 587 - DNA, 193 bp, Ctenocephalides felis
actgaagtttgttgngcgtaaagatcactgatgtggganaagaagncgacaaaacanagnggtaaactttcgacaaggaatacattaccaacaaaattataaaagtcatgaataaattaatatgnaaatattatgataaggattatatacttttganttctttttgtaaataaagattacggatttaaattct

SEQ ID NO: 588 - DNA, 399 bp, Ctenocephalides felis
accattttatatgagagacggtatcctagctttgccatatcattggtctattttaggacagaactggtccctatatatggcaatatccaccaacatttttatgcaatatctaacaaacaatatactgtatttttaccatttatttaccaacgagcaaagttctctcgaatctgatctcctcgactagcgacaactaagttattagtcttaactgaataataacacgttgcctgatatgataatattataaatatatactagctcccagttaagcgcttatatctgtcgctttacaacactttacatattatgcaaatcaggttcttctttctattgaagttccagttgcctgtaataagtgcatccctataatttcgattgtctcaaagatctcactgt

SEQ ID NO: 589 - DNA, 238 bp, Ctenocephalides felis
aaacaattccgagattaacggggctcgacccggcgaaatnggtgcttgcgtatcgagcgcaataaaaacattatataacacaaacaatgcagattattcggttaacgaaattataagtgaaaaaaagtcattaggaaacacaaaaattaaacataaaatcaaacctagcattagcaaaaatgccgaaaaaaatattaaaaaaaatactgacattattccagaaatgttaaaatctggt

SEQ ID NO: 590 - DNA, 500 bp, Ctenocephalides felis
actcggtccganacgctanatgcgaagagcgaacgaaatttcttactatgagcggttgcaangctagttgnatatttattataaaactataataaaattataantcnatcctttaaaaatattttngatacgtaaatccgtatatattacataaatatatggtatnttatnaaagacganatgttttacgtnancatttntgggtaacaaactattanttttaatactatnttaccatttatatatttngctatcttagtatttattgcgtttngatanttcatatnantntaatttncaaatacaatgtgaaaaataagctattacattcttacangcaattgaacgtagcttatannatcatatcatnatttatgtaacnnactattatgttgtnactaatttancaccatanataatannnnnngnataatgttnaanacantcgaattgtcnangcnanantctagattgnatataagtatgattntntgtgatat

SEQ ID NO: 591 - DNA, 427 bp, Ctenocephalides felis
acatatcggcggtttcttgcattctatcataanttgcagccanttcnnactaattagctaccaatnaagnttaatngnaatatnctcgtccatcgaacgctntttaataatctngaagacaacgcgtgcacggnncttattaaatcgtctataacgataatnnatttttatatatacatncatatatgtatactgtatatatncatatacagnaaaaccccgatnagacgatctttnaanaggctggacnaaaaacgcatcttacggcagaaaatantattaaaattacattaattgntaaaacaatgaaaatattttcatttgcnagttttagtttatcanccattcactaaantagctgtaagnggaattctgccttaaggcacnatgncttaattgccttaaggcaaatngctggaacttttng

SEQ ID NO: 592 - DNA, 307 bp, Ctenocephalides felis
antcggtattgccanctgnccnngnggtnngatngacgntgnntnctatgtgcgccggcantncncgattcatngctacagaaacggatcgttaaattttttgcanactattgaagngcatgttttgnntctgatatntacnatcanattacantnncnggatgcggtatanttncangnnncgatncgangaaanctanntgtcgaatggcgntatgaataaggcataacancattctaggtattagataattaccaataacttatccgctagactaatatctaatctaaatatatncgttttcgt

SEQ ID NO: 593 - DNA, 500 bp, Ctenocephalides felis
ccanagnatattatattggtaattncctatggtacaaacanaanttaactaggtataagataaattntcatttcaagacatctgttactttaagttgattagcaagaatctcaaattgttagctgttaatttaaaaaaatataaaagcggcctttactaaaaatgtaaatgtgaaaatattttcaaaaatatnttttgaatacattatgcttaaaatcggattaggattttcagaaaaatattaactgacaactggaaacttannntntttatnntttcantatntatagcagnatanntannnnatntncattctnnncnaatnntgnttnttntcntntnnnnnntnnatttttntnccannctntnngtcccnnnnattntgccnnnntnnntnntntttntnncncacnttnnnntncnnntntnttcntttnnncnnanttctnnncatnttcctttccnctnncntntnctncntacnaactntnttnttnnna

SEQ ID NO: 594 - DNA, 500 bp, Ctenocephalides felis
gnnnngnntnntnnntttggaancacngaagctcttngtnagctccaattcggtttgnggaaaaccctccaggtacggaacccatgggaatgtaaacaaaatttatacttattgttaaaatctctctaaaatatctgataatttgatgtgcatatgtctaatgatcatttttgaccgccaaatggcacatttttttactttttcctccatatctccaaagtcgttggacctttccaaaattttgaacagttcttcatttagtcaatacaaataaaatgttttttaaattattcaaatcggacgctccgttctcttaaaaactgagttaccgttttcggcactttttgccccgtatcttcggaacggctagacctacctttgccaaaaactaatcagcacgtcttcttatcaatatgaatcgaatgttttttaaattattcaaatcggttgattcgtgttcccgaaatcgtcgacgaaaatttgnatccgnacatacatac

SEQ ID NO: 595 - DNA, 204 bp, Ctenocephalides felis
accatgtaaatcgcataattagaccaaatcacgtatccaacaaatctttcaaaataactaaaaatttcgaatcggataatagggttcagataatatcgcatcgttaaatctgcgcccgtaaatctaccaacggtttgatatattcaagcgatcgtgtgggcggcatgtctggtgggatatttactttcacgtctcgcgacgggt

SEQ ID NO: 596 - DNA, 500 bp, Ctenocephalides felis
actttgtttttcttttaattgatgcttgctcatagaataatgtaaattccgggcaatctgtagnggaaaccaggaaatataatccagctaaaacttgacctttggtatcacgtgccagtaatgaacggaagttgtatactaaattacgccttactgtcacatccactgcagtataataaggtttatgcacatatactagagataccactagatttgtagttgttcctccttctttaatagttctgtgttgtcgttcatgccattcaacataatgagaagattgagtgctataagcatagcaatattcgcgtttgcttccacctggcccttcatcacattgtgtaaaccaacccgtatgtggatatttttcatcagccattactgtcactactcttgcgacgtgatatcctggatcacaaaggactacaccttttcttccatttatgcaaatacgaatagcaccataacgtgttctttttctaagcgccgctggagccctg

SEQ ID NO: 597 - DNA, 428 bp, Ctenocephalides felis
actgacttcttgtatttcaccaccgtatacttcttcctgcaaagctctaaaggtctcactcttggcgggatcgtaaacaacagtcggtttatatggtaggcttgttgtatgacgaatcgcttcggcgacgttggcatcggaatagaggccaattggagaattgaattgtttatgcacaaccttgtttgctatgctatcaccagccactctgtgtaatactgaatcggcaaccttttgcttcattaaaacttcatgatttaatgttgactgaacgggagccctcatggccggattcgggtggtggcgcagatagcaatcattagcatttgagtcgcgcttcacctttgcacctggtagcaccaacggggtcgttctgtatggccaaagtgttgcagaatcatccattttatttccgtgatccgtggtgt

SEQ ID NO: 598 - DNA, 500 bp, Ctenocephalides felis
cgtttttcacgaaattatgcaacttgtattaaatcgcttgttaatatcactgtgcatgtccgccaaaaaaatatcataactcatcaagttgtgaaactaaagattttccattattacatattacatactatacatcataatactgaacgaagattattaatcgaacgctttatggagtctgatatatttctgtaatctagacgtataagaatctttccgcttatcttgacttatttattgtttgttaatgattatacgcagcacaattgatattttatcacactttccaataacaaatttttatggtttatgtgattttgtataaaatgctgctaattataaaattattcgactgttattacgtgttttgttggactaaattctaagaaaattattaatatttatttagatatatttgtttcgaatttttatttctaatataatgttgcattctatttgntacatttatttaaataaataatctgctttgnaaaaaaaaa

SEQ ID NO: 599 - DNA, 194 bp, Ctenocephalides felis
cctgttgtttagacatcangtaaacactaaatttntnacaaccgantttnagncantaatcattaatgtgcacnnaaaactaatatttagatgggaaggattggattttatcttaaaaactaaagaaatgtgtcaaaacgtgcgcgttcctcctcggcgaacacgctagccgaacacagtctcgtcggaactgg

SEQ ID NO: 600 - DNA, 383 bp, Ctenocephalides felis
actcaaaaaataaataataataaaatctgtaataagcttttaactgtatctcattcggaataatacagaaaaagaaatgttctttgctgattattccacttttttcacaattgtagattatcatattttatctataatttatataatttttttaatacatttagttttatatagtttacattatattcctttccataatttttaatattccatgtaatatatgtaggaatattttgtacaaggtgttaatattcaaagttgcataaggctttttgagctttaaaagtaaaagcttcaaaaagtttggaacttttcgtattttgatgtgaaaatcctaaatatctttttttttggtttattgttcatagcaaattatacacagt

SEQ ID NO: 601 - DNA, 500 bp, Ctenocephalides felis
actatactatctaatacatattaatacaacagaactgatgcttagcattacattttttttcataatagatctaaaatgcacttcataaaacaacaacaacattaacgttaattttaacgcgttaaaaaaatcacttttaaatatcagaagttatagctaaaataatagcatttattattattaaaatattaactaaattcgtcccaaaatattaaacaaacacaaaaaatcacaatgtagtaaacaatccaattagattagaatcaaattagtatgaaaccaattcgagtaaaatccatacatagatgttatatagagccattaagagtagaacataataattgtagttaaaatgcatagattgcctcatcaaaaatcaacattaaatgttgtatttccgatgatttgaaatcaattgcaccacaaattatctcaacaacaattcacttatacttatatttatattgacatatattcaggtactacatcttatcatttac

SEQ ID NO: 602 - DNA, 500 bp, Ctenocephalides felis
cataataaatgttacatacattacaataaaatattatacatgtattttgtaaaactcatctttttcatccaatttcttagcagtgcaattaactctgtaattttgacgtatatactcgccatggattcgattcacaagttacaaaactgtacccactttggagcccctaaatttaccacccatcaacatatcgagagaatcgaatggaccttatctaaaagtaacccttaggaatacaacggtttatggagcttccaacttcattgtcacggatttaaaatccgatctcaatactggatatttccaatttaatttgactcttccaaaactggacgttgaaggtgatttcaaaatcaaattaaacctgttgctcataaactatagcggtgcaggtcgaatttacatcaacatgactgattaccacgccaggatgcaaatacatggctacaagaaagttgtcgacggaatcgaatccttcaagtcaaaccaatcgacatgaa

SEQ ID NO: 603 - DNA, 220 bp, Ctenocephalides felis
acgcccaattaaaatgacgagtaaatcaatatcttgtcctattataattgcagtttttccagacattgattcttgaattacactttcaacaataaggacatccgcatcatctctggcttgtttagtagttatatttgcagcctttaaattttccattagcatgttaatgagcctaattttattattttgattcgataaaaataattcttgggaaactggt

SEQ ID NO: 604 - DNA, 465 bp, Ctenocephalides felis
acgtaacctgggaggcacacagaagcatctatttcgcgggcaagaacgtaacggctgtttcgttgcacactaatacaccgcggttacatttttgctacgtatctaaattgaataaaaaagcgtgtaggtgtcttttatgttacatacttatttgattaaatttcctgcaaatatagaatattaataataatttcggatcattagtaattttattaaatattatcatttacaatatacaaaatttacatattacatagttaacattagaaaactaaaatttgatagtccataaaatgttagcctataaatataattatttatttattcataatatgtattatgtttaactctcttggcaacttcagttaaatcagacttggcaaagttaagttttgcgttaaatatgttcaactcacttgcatctgttaatgtatctaaaatagaaccaaacatcttagaacattg

SEQ ID NO: 605 - DNA, 231 bp, Ctenocephalides felis
accaccccccaaaacaccattaatctcacggaacgtttctctagcggatttgcctttaacgaaggaaaactttaaaatagcgcgaatttcggcgtaagtgaactccatgtttacacgtctataactgttaaacgcaatatccaaactaatcatgcatagcatcgttttgtaggttatgtcaagacctttcaaattatgtatagtattgccagatacgagctctgtagcgct

SEQ ID NO: 606 - DNA, 186 bp, Ctenocephalides felis
acgtttggtaatgtcacagacgctctctcgcgggcattgtatatggtgtgattcattgccatagttccgcgcgtcgaaatattcaaaatgcattgcttccgttttaacgacggcattcgagtttctctctttcctgcacaagcgatatgctatttgcatacgggcacatataaatccgcgttcgcg

SEQ ID NO: 607 - DNA, 500 bp, Ctenocephalides felis
actncntactatatgtatactttttaaatgactgtaactcgaaaactatttgagatatcgatttgaaattttaatatgttattttcaaaggtgtaatttaccgaaatataaaaaaaacaaaaatcgattttttcaaaatttcacactagttgtgccccttaatccatcttctattgctaaagtgtaggacgtctactattctacacaaatcgcacaaataaaaaattccgacagaaataaaatcccatttcttcaacattttaacttggcaccatcaccgtccctctaaatttcatatgatatattgcaaattattccggcaaacgcgttgcgcaacaatgggcccttgctcaccgtaaacataaacagttcttatcattgacgtgccttcgttctgtattgtatacatatgtatgtatagatacaccaaaaataggtatacatgatgaaatattctgcaacgaatatatcgggaaatgcatgtattatgcattaatcaa

SEQ ID NO: 608 - DNA, 269 bp, Ctenocephalides felis
acgaatgtngcacaatcgatgtgatatataacaacgacccaagcgacgtttttcaaaacccgaatcaatttcgcacaattccacaacgaataaaataaacgtgactaacaaacgatatagtggaaagatagtgccagcaaattcgaaggttctgattctgattctcttctgcaattagtttttaaaatcaaaacattttattatattttatgaagttcaattaattgaaggttttattgaaaatttactgaatttatttccctcagcgt

SEQ ID NO: 609 - DNA, 500 bp, Ctenocephalides felis
acttattaacaaaattcaatcaataaaacttattggtattttaacttacttttaagtatcttcagtatatttttcagacagcctcagaatgcttcagacatctttggaatatttactaaatgctcgatatttaatgagacatgccgctttttcatttgatggccaccaatcaaaatcacttttacagtcttaaaatgacagtgatgatgtcagatgaaagcatttgaagaaatataaaaacattgtaaactgtgaaagcagacaaaaaaataacccaaacaactaggccgattgttatacaaatctaatcaacataccttaaagcaatatgacactcaaacctagttattgtgttaatgaatgagtttcctcagattattaacttcaaccactgaacactagatttgtcagggcctccgactgatttcaattgcaaaattatttccaaagcagcttcattttgctttccaatacgaataaaacattggctgagcctgtaa

SEQ ID NO: 610 - DNA, 500 bp, Ctenocephalides felis
acgttatctactcaacctgaaactttgcctttatcgcaactgggaccagtaattagccctgttgcaaccacattgggtcctgatgcagaattgcatacttttcgagaagcacttgccatgagttctttgagtggacgacgtgctcgacatggtcctgagttatatgcctttgtaactggtgaaatagcaagacactgtaaaagaccagccagtcctggtgatgtcaatatggagtctcccacacatcatagtaagcgggtgcggnttatgtaaactggtaagttaactttaacactaaagnaatttatttatgntaatttacatttactattggtcatggactgaagaatattctaagattgccagtttgnaatccaagttttacctggatattatattttactaaattcgaggaatgaactatgaatgatttcataggtggattaanggaagtaattctttaattttatgaccatacattggaatggaccaaaagncct

SEQ ID NO: 611 - DNA, 140 bp, Ctenocephalides felis
acaacatgccacgggttctattcaataaacacattttacacatgatttgccacttacgtttattatctaagcccaaatcatacccctagaccatcgagccacgggttctatccactgcgtgtttgtgttgcatccaatgt

SEQ ID NO: 612 - DNA, 500 bp, Ctenocephalides felis
actcgtgatatcgtgctaaaaaaatatacaaaagtgttgccatatgtggaacttgaattcggtcgcggcattcatcgtagacacgaacagaatgaggtgtgaatctaaactacattacacccatagatcagggcttcttaaactatgggttgcgaccccaaatggggtcatgtaaaaaaattttggggtcgcaaaagattttaatgccattttattcattttattacatcacgccttgattttttatcaacaaattcttaaacatatatattttcatattatatgtatatgtatattgttaccaaataaataaatcatttaaatttttttttatttatttaaaatcattaaaataaattaaaacatgtttttatatgtgtagggtcgtcaacaaactcgcaatcataaatgtgatcgtgaaggacagaagtttaagaaccctgccatagataaataagcacaaatgtttccttatctatgcataaatgataaaatcattg

SEQ ID NO: 613 - DNA, 146 bp, Ctenocephalides felis
ggtcaattgaatctgagctccagtgcttagcaaagatcagtgttacgtataaggtaattttacataatggcatctttgaagttaaatatcgtaaccaggagcttaagctcatctgcagtcgcgtctcaaatggttaaaccacccgt

SEQ ID NO: 614 - DNA, 162 bp, Ctenocephalides felis
cttaaaaattgatgaatttattctatattttatgatttgtatattttattaatgtttcaaagtattatacgacatcttatgcaatcttgtataaaatcattaatatcatctagttgtatattatttgattgttgactaggttgtaaaatgttttggttcggt

SEQ ID NO: 615 - DNA, 274 bp, Ctenocephalides felis
acataaactacgagcctacaagtcttgtatttgcgaacgaccttttcgaacaattaattatttatttttataattaataagatagattttatgaataaaataccatggtgtttgtttcatttaaaattgcattgtgaacatttaggctttaataatgattacgcttgaattctgtattgggaaatttttgtgactcccatattgaataatttagaaatttttgataagttcacaacaatttttgataagttttattggaatgataatttatggt

SEQ ID NO: 616 - DNA, 266 bp, Ctenocephalides felis
acatcttcgatggtaaatcattattagcattttggaaattttaaacacattatgcagaaaatgtatagttctaagcatttttttaagtttaattgtttaagtctaagttgaaagattagatttagacaactccaatcatttgtaaaaaaacactgcttgttttgaaaaacaaaatttatctaaaaattgacattataaaagattcctaaaaattaaaggtatattgcccataaaacaatcggacgttatttccatatcataaaagt

SEQ ID NO: 617 - DNA, 173 bp, Ctenocephalides felis
acgcggaaccgagaacatcgactcattttatcttttgttaaaattatcacaaagccctctcaagagtagacatacgtgcgaacatttattaacacctacacaggtggaaatgtaacagaggcattgtaattttggaactgtttattatttttaactaaatacgctaaattggt

SEQ ID NO: 618 - DNA, 500 bp, Ctenocephalides felis
actatttgtcgttgctgacatttttcctgtgacaagaatcttttaaattgaatgatcgacaatagcaagttaattaaatgcgtgtgtgctttcgacgtttagttaaatagtttacggcctcattctcgatattaattgaaccaaatcagttccagagaaaccacggtggagcagttcaaatattcattgaagtttggaaattaaattcaaccaattcaggtgtagatacgtagatagcactggaaacaccaaaccgcaattcagcagaagttttatcattattttgttattttttataaattttaaaaactttttgaaatgactcagatctatagacgatatgaaatcttgtaatttatatttaaaaattacccggaccccgggttaaatagaaaagccttggtcaaatcttgaccaataatatgaggaatggtccttgatactctatgcattaagttactaaaattccttcgtacttctcatgaccccttattatcact

SEQ ID NO: 619 - DNA, 500 bp, Ctenocephalides felis
gtntngaagcccttanntnangnttcttngtatttcccgangnccntccaggtacttgcactaaatgtagatcgtaaagttttttatttgnaaacaggtatgtccataaatattgttcgnatactgcatnnagaatattattaattattaaaatcacaaaatatattacagaaaattataaaacttttataaaaatacatatgactggtttaaattagtatgtgattcatcacacacttgattgtaaaatgttgataaaaaaatatgataagagattcaatttaaaatgtaatagtaatctgtaacagttacaacaatatttatatacagtataacaataacaattaaaattgatactcgtatctgcacaaaaagtttcaattgttgaagaaataatcagcatccaatctatgattaatttttggttattttccaatatgtatggacggaaaaataatccttgaaatatcttttggcattcagttcatagctcttcaact

SEQ ID NO: 620 - DNA, 299 bp, Ctenocephalides felis
acatctatatataagttcttatctatattaaantaacgaagagaaaagtgaaagaaatattttntcctttctttcttcttttattccactaacgtggaccgtgtcgtatctgtaattatttctaactttacgctcaatcttataattaaggtctgataatttgccaactattttataaggcccgtgcaatggatgttgtggttagtctgattggccttatctacgaacttcggtgttccctaacacccactggcctactataaaatttggcatttttgtggagctctcacgatattttg

SEQ ID NO: 621 - DNA, 491 bp, Ctenocephalides felis
gaaatgtcattgcaaatcttgatgataaaaaggcaggtagtaacgataacatttttgggtttttattttattttgagttacaactacctttatacctgatttgtagagcagaaaaaatgagcaaaaagttcaatgtattattgatcacataaagcaataatacaaatttttccaattaaatgcaacgcattagtaaattcattgaaatgcaattcctaatgcattgcatgtaaatagacaactcactgctacaaacagtgcattaaattctgttttaggcattagtttttgaaatccattttcattttagatcatttttgctatgtgcagtattcggtccttaggatctaaggtaaaaatttaatatagatataaagtcactgtaagaatgtcatttctgaacttttactagaccatgtagaatataacgagttcatgcttttgaagatgtgaaatcttaattatgtttaaattattttcttctttttctc

SEQ ID NO: 622 - DNA, 121 bp, Ctenocephalides felis
acatatacaagcaatatattaaaagtagtctatttaacaaactttaaaatattataatattgtaaaactaaaaacatatataagaagaattactaaagcaaaattgtaattagtaactagt

SEQ ID NO: 623 - DNA, 500 bp, Ctenocephalides felis
acgctatataaatgatagttttcggcatacttacaaatcactcataaattcttatgaagtctggacaagaaaattataaaattgaataaaagctctatatgcaaacaaatggaaagatgaataacgaaacacttagcgacaatgccagttggctcccagactttgatgaattagtaattatgaataaggcagttaggggcttgctgtaacatttttttttaattcatatatcttcagatccagtgattatatttctacaaaatagaagtggatagtcgctgcaactatttctctaccaaatcaagtaaagataatttcacaacttttgttaattatttcacaataaatcagtttctagaaaaagttcagagttacatcttacctcgtgtttggggcatgttgtaatagctaccggagcaagtagtagatcggcaatnatgctctgataaatcattctctattattntataaaattaacttgttctaagtaattctgttat

SEQ ID NO: 624 - DNA, 409 bp, Ctenocephalides felis
acaaattttctaaaaatattagttatgttttataaatagtttaaaaattacatattattgaacaagaaacaaactgtagtaaattaaaaacaagatccaaatttccaaagcaatttgttaatcaataactgaaaaacgactcgtcgattattgacaaaatttaatcagcaagattctcaaatggaaaacgtttgtaatggtttttgaatttttaaaatcaattcactaattaaaaatttgagacttttttgaaaattctaaaggcaaaactaagcagcacgagtgcttatcgaatttacgaattttgacgatttttcaaatgggattgtgcatttttgagaaaaggccactaaagatgaaattttgctcacgtaaaaaagcgccgctcatttttgcaatctttgatagt

SEQ ID NO: 625 - DNA, 600 bp, Ctenocephalides felis
nccatnaaattngtaccaaaantaantttggatggggtcnanccgncccnttanttggnccaaaagtaanctnnggctttatcntantaaatanggcccagtttattttaaaccttaattctaatccttattggttattttaaaaagccntgagaccnttaagtaatattgctgcgtgattcccttaattgngcattcatcaacattaattttcggctaagttttgngntgngntcttgnaagtaactaataatatcggcttgnttttcaagaagttctgctatatttcttccctgctgnggaaaaccaacagcatcgctcctctgnccttctgacatggnggccatttgncttatccattcacttttcaaaacatcgggtggnaaatgnttcatattaaaatcaaaggccttattaatatatccccattaacttccattaaaactgntggttcacaataccaatatggtacatatccactggagaaagaatacttgcttcacaatggtttggnaaatcatnctcataaagtggttgcttaaaggttgcatacccattattcagcattccatanggatctccntnttaccgatatctatg

SEQ ID NO: 626 - DNA, 480 bp, Ctenocephalides felis
caaatttattgtagttgctgaatgatgacacgcatctggtgtcgaaacgtataaataaaagtttttaatactttataccttttttatttcgacgaatgggctgctagtcactttgaaatatgtatatatgttcgacattcttctcttattacctttgctagcctgcatgcatttatttataccccttaccccgaagggtcttggatcaaataccaaaatcctggtcaattccttacagcagagtaaaaaccaatgtcactactacacttcaatcttctgattgaaatcccattgctctaattactaatccaaaccaaactctatctattatgtgtttttgaaaatcaatacgcctaaaactacccgtaaactagactgctaataactggaaacgaatggcacactcactttatacgtctaatctaaaatatttacttcgtgtaatataatatgggtaatgcatgggagaggaaaggccgt

SEQ ID NO: 627 - DNA, 600 bp, Ctenocephalides felis
acaaatatattctttaatacttactgtatagtgcattatagaacattatgatccgctaattatgttgatttaattaagtgataacgtaaatagtcaattgacgatttattacttttgacttaagtatatggctaaacaagttagaacaatttaaatgaccgacaaacttcatatttgtagttgatcatttcaggagatcattttaaatttttttggtttaagtttcaaaatagtaatattttgtttgtgaccctgggcaatgcgcgaatataataatatgattttatttacataatgaccgtattaattgaaataaattgacgtcgaaaatgtaatagttttaattatttatgatcaaacaactatcaaaacctaacattattcatgcattcaagtattagtgaatgtgccaatttaacatgttccggaaaaaattgatttaagtttggagcaatataaaataaaaacgaaacacaacgatttttcatgcgaataggctactgataatatgttttattgcttgccatttggttaattttatcagaaaccgttcgcatagatttaatcgggtttcgaaagccagttaatncagtgacgcat

SEQ ID NO: 628 - DNA, 500 bp, Ctenocephalides felis
accattaacttatttttagaaaaggttcaggtgtttttacatattgtctttctcttttttagatgacttttatccatttttaatttgggatgtgtgttattttcgatatgtagttcacatagaacacaaaaatatttaaagtttggatctcctaaatatgctggtgataaggaacgtaaagctaaactgggatcacactcaaagtgaagccatcttaaacacattccacattgttgccaagaactgctggatggtattaagtccccattgcaattgcttttgcaattaataaacgcgtcttgggaatttcttagacatagtgaataactgtaataataaataaacaactttatttgtaatacaaacaaacttgttaattctgataattcaaaattttgtgaaaagatatctttatcagaattctgatacaaataagcacatatatctaaattattatatttacttacagaactccggcttctctacaaaattctaattag

SEQ ID NO: 629 - DNA, 111 bp, Ctenocephalides felis
accctactaagaatgtgacagaattttaaagtcgggacgtttaatagttttcgagatatgcgtggtcgtttggtcgctggctctacgaccaatactaatatttaaacaggt

SEQ ID NO: 630 - DNA, 103 bp, Ctenocephalides felis
acacatcaaattgatttcaaatttaatgataattatatttatttcatcattctaagaataaagacaagcccatgcatcacattattaaacaggtgctttttgt

SEQ ID NO: 631 - DNA, 500 bp, Ctenocephalides felis
actcacatctatctaaacatacatatatgatttgcagaaaataacattttcaagtcatatatgacttggntttgntcantaccnttntaantttggnaatggncctannggnnnannncanggcttatttataatgaatgtaaatgcncaaacatgtgaataatattaataggattagtatgcacgaaaaaattaatancaataaaaaagaaagttttggattttagattgagaattaaaaattaatatattagatgtaatgattaaagtgcaaatgtttagctatattttaattgttaacagtggaatgtttattttgtattgaaatctgttattgctaatgtgataaacattttttctgtgttatgcacatcaatttttggtattactgtgttttaactgtaaattataatattgcaaaaatacattagtatattttttcatgaagttactaaaaataattttatcattttcaaaattattgtgcgcatgtatttaag

SEQ ID NO: 632 - DNA, 500 bp, Ctenocephalides felis
actaaatgttaattgtgcgagaatggtggatgaatttataaagaaacatatgggattcatatngaattaataaatgtaatgcaatgaaaacattcgtattaacaaattcaataagaaacaacacgaacttaatacttgtaacatttgtcaatgcgaatggttcttgcaaaaaagccaatacaaaaaatggcaaatattatatatgtatccttgaattatttaatttttttcaaacaattttccaaaattccnaaaagagagaatgtataattcagggcagtagcttaatgataaaacgatcgccggaagcattttagcttactatgacatgactattatgaaaataaaattgatataaaatgtgaaacatttgaactataaatattatatttaataataaatttgntattgntatatcnacaaaannaaananntngctgtnanaanaaaaaaggttgaacttgggccgganacccgntaggccgaattttgganatttc

SEQ ID NO: 633 - DNA, 392 bp, Ctenocephalides felis
acaatgtgattcacggaagccaatttttcttccaatcacacaagatgaccttgaccttgtgcgtttgtggtcacaatttagaacaaaacacatccaactcttagcaaaattacataaacagtaaaatactttaaataaataattagccgtcaaaactcccaccaaattttatacgtctgtttttccgtgtggaggatactggcaatgagaactggtttcactaaactcggcgctcttcaaacatttcgaaaatcttagggagaacaaaattacaaataattagtcatattacttacattatctttatttacatcgtttagtcatctactttttttaattatttatagttagaattacaaattgatttcagacttaagcttttcaaactgtgt

SEQ ID NO: 634 - DNA, 413 bp, Ctenocephalides felis
actacattggaaacagccagtgatataagcaataagcctccaccgccattaaagctgctaatgaatccgtatggtaaagttttagacataaatactgtgtataaagaaactggaaccgaaccgctcagtccggatttaaccttcaatatcgtcaatgctctgaacgcgagcaaaggcagaggtgctgaattgttcgctaagcgccgcaagaaatctgagaagtggatcgtagatgaaacaagaactactgaaaaaataatcaacaaagaaaattctgttcagcagtattggaaaccatcacaaagtccgttatgccagactaatcgattgggttcttgggaaaaaccaaaactgcaaagtaataacaaagagtgcctttatacttctccgattcaatactaccaatcgtgcgt

SEQ ID NO: 635 - DNA, 649 bp, Ctenocephalides felis
acatgagnaaaaagtgtggttatatatattttttatatttaataaatgatatattcaaatgcattnttttttaattctctatcatattcaaatgcgcttatgatacaagtgcaaaaattacatgcagttttcataatccaaaagattttataatcgtgtaaatgtatttatagagattgcactactaggtgggcgcaataataatgctcttactaaataatttaatacatatattagaggcaccactctagccttatgctaattgatttgatctatattcagaaatgataaaaattaattcactgtagcagtattattcagttgttttaattagaattttaatctaaattgcaaaatttgtatatgaaataaaagaataggtaatacactagaatacaatgaaataaatgcaatgaattagatcacaaatcattgacttgnttttttatattaaattcaaaagtttttataaaacatttcattgaattaaatcaataaagaaagatagaaatccaaatattacaagatacattattgatattttataataatagtatgaatccataactcatgtggcacagccattattaacaattaaattaacaatatgaaaatcctaatattaaaactatatttaagaaagcacatt

SEQ ID NO: 636 - DNA, 500 bp, Ctenocephalides felis
actcacatctatctaaacatacatatatgatttgcagaaaataacattttcaagtcatatatgacttgantttgctcattaccatataattttgagattggcctcatgtgatgagacgaggcttatttataatgaatgtaaatgcacaaacatgtgaataatattaataggattagtatgcacgaaaaaattaataacaataaaaaagaaagttttggattttagattgagaattaaaaattaatatattagatgtaatgattaaagtgcaaatgtttagctatattttaattgntaacagtggaatgtttattttggattgaaatctgntattgctaatgtgataaacattttttctgtgttatgcacatcaatttttggtattactgngttttaactgnaaattataatattgcaaaaatcattagtatattttttcatgaagttcctaaaataatttatcatttcaaaatatgggcccatgtttaagggaaaatgaa

SEQ ID NO: 637 - DNA, 500 bp, Ctenocephalides felis
actgaattatatcttaattaaattttggtatatttcgtagaaatataatcgaggatcttttcttcaagtnccaaatgatactgttacgacaagcccctagtcgtcctatttaatttcaatttttactctaattgtcgtttacaattgattttgagctgattttccgtggctttagacacgtttttccatggtttggcaaccttgttcgattttttagttcttttatattgaatcgtatgatcgttgttcctttaattttctttttgaaacagtccttgtgtggtttgattcactattttacttttaggctgcactcatagtcagtaattaatatacacgattgctgatttcatataaaagtaatgtaatgtaaaactagaaatttcataaataatcaatactaaaaactaggaacgaaattaaagtctgncacttncttttgcatatagtccttctaaaantagaaactcaagaagtttaactatgttgcaaagtttcag

SEQ ID NO: 638 - DNA, 500 bp, Ctenocephalides felis
acanagctgnaattaatattatattngtcggagggcattttcaatcnatatcctatagtcgaagtgtcgatgtgangagtccgcatttattattcagacttctccatttcccgctttaacgtttcgatataaaatcggttatgatacctnctaaattctttacggccttattttagctttttattgttccgtgntttgtatactgaaataatgatgaatgcgcgaatatttaatttacagtcttcaaaggatatctaaatgttgtcgttttgncgntcgtctgcctgtccgtctattgggcttttgtgaattaacaataaataaatatgtattataacagtttagactatcgtatggtagcaaattattttattcaactaattaaaaaaacaggcattatcgatttataattcttgaaaatctaaggtgtgataaanaaaactggtggtgtatggagaggagaccctattttntcaagtaaaaccgggacgataatttta

SEQ ID NO: 639 - DNA, 112 bp, Ctenocephalides felis
aatttccataattataatactataatttatctttttgatcgctttatatgtgcaaatagagcangccaagcgcgcatcttngcagaattgcgaggaaggtattcggggccga

SEQ ID NO: 640 - DNA, 500 bp, Ctenocephalides felis
acgaacaaagttttttcgtatcttttactgnttagctagtagagagcaatctgngtgattgatcacttattgaaatgcaaattacatttagattgcagcaattattgacaatatttctatattttcataaagaaaccatataaattataatacattgntaaaatttcgtatggntctccagtcattcaattctaataacaatcaccatttaggctaaaatcttgcatgttttctgccctcgaacaaacggntattcacggncagcgtgtttagatatagcagcagagccgcatattcagttcagcaagcnttcaagaataaaagaataaaataatatttattaaatatcaactaatatataatcttttctcggcaatgaatataaganattattattttattctatacantggattaaaaaaaaaaaaacataaatttatttttattattaatgctaaattatttatcnttcgtttattttaataaanataattgaanga

SEQ ID NO: 641 - DNA, 322 bp, Ctenocephalides felis
nnnnnntttagccccgntgtgnttcggcgncgcccggcggtcatattaaaacaaccggcgccgggtttttcaactgaaagaaatgtttttttaattcaattatttataattaaatacaagtgaataaaaattacatttaagagtattattattgcttaacaaaagagtattaaaaaagtctactgatcataaatcaatagtataggaaaagattggtaatatattggatgaaggtaaaatacacaagaaatcaataaacaaaaataaatattgtgaaagttatttacgcgtatataaatcatcttttaacaagcatcatcgt

SEQ ID NO: 642 - DNA, 500 bp, Ctenocephalides felis
actccgcgaatctattgtcaaacatgcttttaataccttttatcatttctgaagaatgttgatcccaattatcattatttaacctttcaagataagatttgaagcttttgttgccttcttaaaaaatttttaagttctgccattttaattgtttttagaactcaagataacttaatttaattttttgatagggaagcgcaaaccgttacaaaattttacgtataacaggcgttatgcaatatcagcggttatatcagaatttaaatctataatcaattgattatttaacaattctaatttaataatattagaattggagtctagcacatcagtaacataagttgnggngttaataaattaacaaatatataaaccaataattagtaatgnttataataactaatataatatttcataacaattaataacctaaggatttacgaaattggcccaaaatcttagagcaagaccaatttcaatcaataatatggtcaggttta

SEQ ID NO: 643 - DNA, 127 bp, Ctenocephalides felis
actaaaattggttacaagtcgaagtccagtattataaaaaagttttttccaaggaacatacaattctttaatgtatggcaaacatattacaccagaatgagtttctgagtcaggtaaatcgttatgt

SEQ ID NO: 644 - DNA, 393 bp, Ctenocephalides felis
acaaaaaaatgtcccgggcgttaaacttaaaaggcattggtctctgaaacaaaatcttgcttgaataactaaattttttaatacaagaattaattattcggaaaaagtttgagattgttttaagcttaaaacacttgtgaaaagttttataaaggaaagtttcatagttttggagatatttaattaattgtgcaaaaaggtcctgtgcgtcaaacttataaggaatagttttcttgaacaaaaattagtttgaataactaatttttttaatataaaatttaattgttgggaattgtggtgtatgcaaacgttttagatttttttatgcttaaaacacttgtgaaaagttttatgaagaaaagttttatagttttggaaatattcaattaattg

SEQ ID NO: 645 - DNA, 394 bp, Ctenocephalides felis
actttaactcaatgctatttatacaggttacaatattatatattaacccatctgagtattggaaaaaaattaatactgcttattataatttgtgataaagcacaaaattcttaatttgtcactgtatttttacatatgcttaaattataatttaatattatttttagcatttgttggtaacttttaattgtattctactgatatagatttctatgtaaggaggtttaatggtttttttacaattcatgtgtggtattttgagaatcaagaaagcttttctctaatattttatacctctaaactgaattgattaactctattttttcttaatatttataacctcctgctcctccgcgctgggtgcgaggtattgattgcttggaccgcgcgaagt

SEQ ID NO: 646 - DNA, 435 bp, Ctenocephalides felis
cgcgggctccgatncnnaatgcacgacntntanggcatgcgtgnaagtgcgctattaataatacagttacaaagattantgnaacntanaantngccaancggaangnntacgttgtaatnanagggaaaacgttttttcanncntttntntggantaagatngttaaattgccgattntcaacangnatnggnnnagtannaaacnaggctcaacggcaaatgccntccacctaaattattttgtgaacccaaanaaaactatccatacttnattantntngacggtgtcggtccattaaagcatgananttnnccgcatntntntcggtttttgacannangngtggnntgcaaacncngannnnangacanactnaatncnagnatgagtgagtgngcgtgagttagagcatncnaaanggatgcgccgttn

SEQ ID NO: 647 - DNA, 492 bp, Ctenocephalides felis
tcntacactacaaaaatgatttttatatttaatgaaaatactnatttataaaatatctcttcaataagctatagttataacaggcncnnttaataattatgaattgnnttgaaaatgatttacaataaagctatgtgaaacaagnntgtgtngtatataacatcatcgcgtnggncgggcttttccttgttactatatttttaaaaatttaataaaattagctttgtagcaaatgctactgtntgataattgaattttcangaatagtaggagttgtagcaggagtcttgttagcttcacgccatgcttcatcaaaattctgaatagaattagaacnagatgatgaaacttttgtcttaacgttttcataggctggcccatttttnttntngtgatttgaaagantcagaatttctcatctgcccattttggtgnaaacccccgtatttcccttacaaanaagagtttttcggggnagaattantactnggc

SEQ ID NO: 648 - DNA, 417 bp, Ctenocephalides felis
acgccgttggcgatttccgtgaaaatgtttgacaatgtttgttccagggttggcttgaactcttggaagaatagtcttgcgttgtcgttcacagcctggctaagaattgttccaagggtttgatcgttgttaaagagaccggataggcgtattttattgtttcccaaaataattttcatgtcgattggtttgacttggaggcattcgattccgcgacaactttcttgtagccatgtatttgcatcctggcgtggtaatcagctgaaatagtaatataaataaattactataaatacgcaattactagaaatagtaatgtaataagttaacacgttcgcgggtgtgaatgctatagcattcatcgtatataacgattaaaatatgatgattttaatactaccaatataatatgaatgt

SEQ ID NO: 649 - DNA, 500 bp, Ctenocephalides felis
ttctaaaataatattgaataaaaaatagtagatacaatcagtggcttgtataatagggatagctataagtagtgaaaatggaagtgcttattagaaatacttttacaaaacgaattgtaatgattcagtagcaacatattaaaaaataaaattgtcaaaatacttgcttcaaaattatgctagtattcttctcatgaactaacattagcttaattttataattaactaaaatttttgaatatcctcacattatcgcaaatccttggtgactacatcgtcttagcatattacctagaaagcatttcaccatcaactgacaaatttattggacaattgatgcctaacgtaattaccaatgtttacatcaagtaagatgctaataattaacgttatctatgtgcacgtaaataatgaaacaataaaatttcgtgagtttcttaagcgtgcgtccctcagaggtcaaaaagtcgaaaagtcgtagggtcatgatcaacgaacgc

SEQ ID NO: 650 - DNA, 500 bp, Ctenocephalides felis
acctactatcacagtttttttttactaacagtttagctataagtaggatggtgaaaacttttaaattttttacatcttactagcgattttgataatactgattcattggttataaatcttcaaagaaattcttagttttctacgtatactcaaaacgtagtcaatacgtatatatccaaattttacaccccatttgtgcgatttgctgcgcataattatatttacttcgtatattgagcagttactaaaattgtatactacgttttcctgaatattattgaacatgtgttgaataaatttacaccttacctttattgaaaatatttgtttgtcgatagtaatacgtggtctttttacaacaattttgattgctgtcaatgtagttgaaccaacctttgggttcaaaacaaaacctatcaatttgttgtttggattccttcgtaaaaatctgctacacatagacattgagcaaaaatcagaaaacccctttgtatccgnag

SEQ ID NO: 651 - DNA, 483 bp, Ctenocephalides felis
acacctattaaggagcaggtttcaatattactcctaatgacctattgcttacacattgttatataaacatcactaaatatataccatcaaaacttctacaagctaaagcagtaaatcattaattaacatctagaatatacaaataagttttcataaaattttcctattctgttctaaatatatattttgtgcatcgcaatgaaaatactaagacgtatatattaatattaaaatatgtaataacttacaactgtcataaagatagtgagttataaatgaaaatatctcagatggtatagataaatttcaaagttttaaattaaaaactttttcgaaggtaacgcgaagtgcaaacgaaagtttcaccataaatagttttagttcattttaccataactcgcgataatactaaatcgatgaaaggctgaattattaaagttatcagaacaatgaactgttagcacacatatgcacatgtatatg

SEQ ID NO: 652 - DNA, 500 bp, Ctenocephalides felis
acctcatgagcagttgcatcaatcataagtcgttgctcgtagctcatcgcaagcaggtgcccgcaaattatcgcatggtgattcttgagtttctcgttaattctaaaatgtaaaataatttacatgtaatatatacccaatacactattacatatgaaaacttattatatatttcttcaattcaattattattattatattcaatatatctagcaaataacgatcgcccatctcttcgcgttcagtgttgatgtcaaacctgttcaaaggagattggaaacacgttgtatttaattgtggtagatatggtgttatcctcttttggtgcgaatagtattatttttgactagcttattgaataatgacccataagtatggtttnaaaaantcttagcntttccatgtaattattttgaaagacatattgacaaatcgttgcacaaaganctcccatttngttatgaaattcagatgnnttagttttagaaggggctatttat

SEQ ID NO: 653 - DNA, 500 bp, Ctenocephalides felis
acaatgtatattgaataagatgtgagcgataccttgnagggatgtcgcattgagaatttaggtgtggaaaattgcaatagcattaaaatataccatttgaattagatttttaaataataccaaaacaaatcataaattaaattctttcgtagatattcatacataaatattggctttccagaaagacaactatgtagatttcacattcactccaaaattaatgagttattatataacaaatttttaaataacttatatacaaacactatgcacaagtgttgatgatatatgaccttaaaaagtaattaaatattgcgcttaaaaatcaaatttacatacacatttacccattctatctctagaaaactagaacagatattcttatgaaaaatttgctattttaaatatctcaaaggtttggaccatcttcataataaaatccgtnctcggcgngacacgctagcgatctgggatttcatacctgnggcggtcggctgctt

SEQ ID NO: 654 - DNA, 330 bp, Ctenocephalides felis
nccgcanccaaataaactcctcttcataaattaatccnttatgttaacaatttttttaaatattganaacaacctttaaanatcgatgaccttaacatattaaagccttacttaccgcaaaatgaagatcaaattgtggattgtcttttattttttacacattccaaacttttgtcaatgacaatataatattaataattttcacttattttatgtcacacttattattattattatgatcgaaattaattttaatttaataattaatattcgttgtaacctcatggaagtatcggtcttaactacgcggctttgtaacgataacaatgt

SEQ ID NO: 655 - DNA, 500 bp, Ctenocephalides felis
nttctagcccttgggnttttattcccctaacggggccncgggcnngggaccaaaatagancntaatatttttaatacngggntaaaagaaanggtaaaantttgggaggntttaaaatctctaacnagggtaaacccnaaacnaaaaaaataatttaatcattactctctttaactttatccntggcctttataatacttatagataaaatagaaaatagtttaaattttnctnaacaatgaattcattgntttagagacgctctttactgntctatcctacaaaatactatacnagccnagtatttttgaatatgaattggatatttctaataaagctataaatacntacngtatttttgaatttaaacntttctttatggtatcttccncagatatttggtttccatatctacnatcnccntgaggtttcttctaatttcatcaattcagaagacntttctttttcaattttcattatatttgccncnggatttcaac

SEQ ID NO: 656 - DNA, 73 bp, Ctenocephalides felis
acaaaaacataacttcattgagaaaaagcaattaaatcattttcacactttctaattaaaatgaaatgatcgt

SEQ ID NO: 657 - DNA, 425 bp, Ctenocephalides felis
acacccctgatattacaagttgctaaccactgtcataatattagatttntaacaagtccagactgaaatcttagaacccttgagctttagctgatattaacggttcatattaacttttctcagactattgcgtagtagctgacattacacattctctcacgaaatcataaacctacatcgacaaatctcagcaagatcatattatcgacattccgcctagttaacaattttcaccaagtttgcatgaataacattttgtttaatcggctaaattcattactttgtccttttcgttgcatagaatattcgagacaaatccccactacgtttcaaaggattttagttttaataattatgaaataaatcagtcttaatctgtcggtcgccgggcaaacacttctctttcaataccttcgggttccttg

SEQ ID NO: 658 - DNA, 500 bp, Ctenocephalides felis
gatagatccntttcatgatcaacataataatacaaaattttaactcaatttcaccgaaatgcttaaaatgtaaaaccttgccactcgctcgccaattaaatcttgaacgaaatagaaaacgacgttgctctttcaaatcttgcataatattattcctagaacacttaataaaacaccgatttaataagatttttattgncattattttgntcattacatgattttcgttaaaatatatattttaggtatttgcaaaaaaacgacgaaaaacgacgaaaaacgccaaaaatatatgaatctttagtagccagtaacttgaaaagtatgaagtttttttgaaaaactataaaatccttatttttaaaaaaatacgtaattaaacaattgagaagaacccgaattgntttcacttttgaacttggtgtagatgaacctaattcctaatttcatgcnattcgggacacagtaaaaaattcagacacaaaacgctcgttactgcc

SEQ ID NO: 659 - DNA, 500 bp, Ctenocephalides felis
acaacattgttgtaaataatatgttctcgatccaaaatacaatactgtagggaaataatatgtgctcgaatttaaagaaatgtccgggctcgtgtaaactacatatatgatgaataatataatcatcaaatactattgggtataaagaaaatgcattgaatattccagagtataaataataactactttacgctcccgggtgggctcgaaccaccaacctttcggttaacagccgagcgcgctagccaattgcgccacggaggctcttatcgcttcttgataatagtatgaataaattatttatagcatgaacaataattataattattgaacaataatgagtataaacaacaattattcttatacccaataaactacactaatctgtaacccacggcgcaaccagtgcccaatacctgtcatacatcgcgctcgattcacttcacacacaaatagttaacatttacttcactcctataaactatacaaactatcaaagt

SEQ ID NO: 660 - DNA, 500 bp, Ctenocephalides felis
cctttagcgaaccgcgtcagaatttttccaggattcctcaatttgtttataaaaatataataaattttcaagtatttcaattttatttgtaaaactacatttttgtatcattattatcacgagcaagtattttgtgccgttgtagaaaacagctggaagcacttaatgcttattgtgttcatgttctcattactcaggaatatgagaattgagaaatgtttcatttgtaagtccacactttttcattcattagaaagctctcgtcttgaagtcgtttactcaataatttacatgtttatctaaataaagaaatagtagaaacttaaatacaaattggaataagagcatcggtagaatatagtataaacaacaaagcaattttaaatcattaaattacaaaataatcctcagtttctctattgtcaaagggatgtgaaatattttgatgnttaattttcaaaatcttttatttaattaatcaaaatattattccagcgact

SEQ ID NO: 661 - DNA, 412 bp, Ctenocephalides felis
actttttgatatttatgtaatgattatttattcaccgatgttaacagctcaacgtctgaacgaatactccaattaaaggttggatcagcgaattattattacaaatgaagatactgaggaatgactggagatagctgcaacaaactatttatgtaaatacaagcagtaaattacctgcaacagttttacacaaagtattgtattacgtaatagccggtggtgattttctgtttcaaaaagttataacttttcaagactgccagtatggtcaagactactgtataaaattatcaacaaattatagaaatatttacaataaacaaggttttaaattttaaattatataaataaataaatagtttgatactatttaacaatatggttaattatattgctcttcgaatgatatttg

SEQ ID NO: 662 - DNA, 500 bp, Ctenocephalides felis
accatagtggcgcttagactgtgcttagcttgggtaaatttttaaaattttgaatccaaaattacataaattttttatggaaaaataattgtttatcctcaaaagcaattgttttgtcaatacaagcagaaagtttagtcaaaattctagtagatactttataagaacaaaaattaggcaaaataatattttgatttttggcaagtttcaagtggtaaatagttacttaatgcaattgactccattgtaaaaattggtgagggtaagttatagtaatagcaaaaaaaaggagaatgaaatatttcacatgtctttacattgcaaaggtttctgatcgttttaaaaaaaatgatgtatgaatgtgtgtgagaagtaatttttctcattatgttatatttaataaaaagtaaaaaatcagaatttagggataaaagtagtttatgctgataaaaaatctatatgtaaaatttttaggtatatcggtccagtaaaaggtgaga

SEQ ID NO: 663 - DNA, 500 bp, Ctenocephalides felis
ncatnaattacttgagccacaatgtataaatntttcactattaagatntataacttntctttttcaaatcntattttgggataaantaacttatcataaaataaaatactgggtaaaagtatggataaaantnatatcancaataaattttcatgaatctatntaataaaatggncaacatcgntntttaataaatgggcttcaaatttgactngaatgaatacttgntattgcttcctaggtaaaattnatatttttaatggacaaaatgttactataatattcttnnatttatataacaagaaaaataattctaaaatcaatttctttgattcacctgttattttccangtgcgcggtaaaganaaaatagttacngaataatanaaatcaaaagtgaaccggactgtgtgcaaattttatgatcgagatcttgaacagagtntttgtaacacgcatctntggtttagtgccattgaatantgttatggtgggggtgc

SEQ ID NO: 664 - DNA, 295 bp, Ctenocephalides felis
acttatgacatatcatattataagtttctaacaataatccagtttcactaatnaatattccnggaactatgcttatgaaaaatgaattaaataaaacatgaattgctacatttattcaaaatttttgaagcattaacattagtatacagcatagaatgctacaattagccagatagtcagaaatcatttcaaaaattctccgttcatggctttgttaacaacaattattttaaacggatgccagttagattgttttagaataaaacttttgagagaaatataatataataatagt

SEQ ID NO: 665 - DNA, 310 bp, Ctenocephalides felis
acttcaaaaacgcgtataaatagcgcgaagtctaattttctagtttttataattaattaattttcacaggcctataatattttaatattatgattttgtttatcatctctatcaccatgcgacgtttcataaattttgcagataagtatatctgaggttctccttgtaagttgtccgtgttatttaaaacaagtatgatttaatttagcaagaaccaaaattagatacttttaaaaaaaattaaaaatgtaaaaaaaatatttgcaaaattttccccatatactattccacttaaaaatgcccctgttgt

SEQ ID NO: 666 - DNA, 365 bp, Ctenocephalides felis
acaaagcatctacatatcggagcctccagcaatattttcgcataatatttttctgcgatcgattttctgtcaaacgctactcataaattataccgacagaacgaacgtagcgaacatgaaaaatatctgcgcaaaatctgcgagctataattcaaactttaaatatagtcccgctttcacaaacagaagatcagatcaaaagcttcgatacggcgataaatcggatattataccgactcaaaacgtcgagaatggagaaaataatacgatgctgtcgaatccggtaatagatttgatagcaaagtataaagttgtgtaattacaaacccataaatcattttctccataaatatcaaaatctcggt

SEQ ID NO: 667 - DNA, 385 bp, Ctenocephalides felis
tggngtttttantgggacttttnaaanccccgccgngcagtacctttattattatgctttggttcacgtcgggtataaaatgttttgaacaagacaaagtataatataaataagnataaaatgttttgaacaaaactaaattaatatataccatttctgggaaccattgcagactgataagatatcaaatgctattgaaacgatatgatttcaagaatcaaaacgctttcatctatcttttatatttggctatatttgtcattttccatttatacagtgaaagccgactattttcactaaaaaaccggtttttgaattccacaatttccgcaaaaaaccggttatcaaaaccggtttttgaaaaccgacaaatcctacttacagt

SEQ ID NO: 668 - DNA, 160 bp, Ctenocephalides felis
aggnntngngaaccctttnaaancnagacttnctttaannccccgnnagttacatggntcaaggagnctagccgccatcagggaaagttncagacataccgtttatgtcgaacaaatgaaagatggcgaaggngctgtcaaactggaaatttcanaatgt

SEQ ID NO: 669 - DNA, 320 bp, Ctenocephalides felis
atattgcttctacaaatgcaatgaaaagtcaatttgtnttgaatgtcacgtaaactaataaaggaacttatagataaattatagcgacacaataatatttttatttcatacggtataatatcatcattagtataaaattttccgaaatactcgcataaactgctaatataatgaaaacaactcacgtattccgcaagggtgtccaatgcatggatcgacacatttatattgagaacacgctaaatggttggggcattcactatcgctaaagcattcgccctgaaacgaaataaaaaatttaatttaacatttgactgagt

SEQ ID NO: 670 - DNA, 500 bp, Ctenocephalides felis
acaacaagttcaaatcttcttgtttgtgctataattttctatattcattataatataaccttatttttttaaggnaagtgttacacattttccaatgaatcactatgtaatgtgatactctatttttacaagttgtgtgtttgttgagcaaacatcataatttttgaagagacagttaaatataaataaaaattcttcacgtttagatatcgtatgaaatcgttcgaaaaataaataacagtgataaatttttataaaagcaaattgataaaataaagtttgataaagaaaatgcaattttagctaactggactttcagtgtagtgatatcatatcatgaatttatcattaccgattgaatattttatcacaataagttttgtgcattttatttgaaaagggcttgctcgtggcttaatgattatgaccttggctttccaacaagaaggntaaggcttgatcccatttgaaaatcagatggaaatatatttctagtgata

SEQ ID NO: 671 - DNA, 332 bp, Ctenocephalides felis
acaaaaagatatgatttgggtcttatcattattgagaactagattattaaatttatttganccaaagtaaatcngcaatcatcttgtgatcaatttctacctctgatatttttctatgttagcattttttatcataacaaatactattaaattacccattgattattatatggtttcaaatggtttatgttataataaattacatataaaatatataatgatatatcgcgtgcaaaacaaaagttatggttaaatcgcgtgcaaactctacaagtataaacacctaattaagcaaatgttttcaattaaatgtaaaagcagttttcatatag

SEQ ID NO: 672 - DNA, 500 bp, Ctenocephalides felis
actactcatgtggtttttctcttccatccattgtctatttcgaaaccttcactatcaagaagcacgagagccttccatttattttgagagttgaccaagaattgcagtagcagccagctgcagcatatttcatagctgatgatgtttttctaatattctttgttttgcattgccggtattctctgtaaaaaaaaaattattacattaattattcaaatttatataaaaaattaccgacgaattttttaaatcatttatattatttgactgcaatactcgagtaaattaaatttgtaatgtaaattcatcactgataaaatttttaaatattatcaagcagtttaacaataacttacatatatttgatataaagtctttgattaggtagccatttactagtaattctaggatttgcatcatacatcctctgatttgcctggctttcttccacagtctcgcttgacgtgtttagttattcaagccaatccattgcccaaatg

SEQ ID NO: 673 - DNA, 500 bp, Ctenocephalides felis
actatgaagaatgnttctatataatttactgnattgnagttaactatatttaaatgctaacgtgcatttatatgttaagnttagatttattattgntaatattatatctaaaatgattcctacatataaaataaataaaactttctgttgttaaaactttagaaatgtagttattttaaatgttacattattgaattaatacaagttttatatacaatgaaatatgttttaaaattgtatattgntcattatattttcatgcgccagtaatagttgctgcaattccttcaccacaattgaagttttcttgtagttgttgcagtttgtttaccattcatcacagtagacaatcatccaaaagtagattgntaaccatttccatgaagtagaaatcaccaagttagacttcgaatgacatggcttaattctcctctgacagtatacaaatctaactccatatgatttgttcaggaccaangacgcatttaacatgcctcctc

SEQ ID NO: 674 - DNA, 296 bp, Ctenocephalides felis
acaaattttagaatgtttaaatcattaagtttgaataaattaccttaaagatgaaaatttagctaacattgtaaaagcatgttttgttgtaattttttaaataacgtattttagatatacttttcgcttcttaacaagccaaattatgaatgattctcatgtttagaaacaactaataaaaaataaactcagtgcaaacataaacattaatatagacagattaagtagatatatcccttcataaattaattgatgtcattcattattcagataacacccctagtcaataggtttgt

SEQ ID NO: 675 - DNA, 461 bp, Ctenocephalides felis
cataataatcttgcaaaagtaatatttgaaatgaactatactacaaaacgaaacagcccccacttcctagaactaactccatctgaaatcgacggaacatatcacttatcattgattagtttgttttattatatttacaaatatagacaattatttttgtatggaatgaaacgagtttacacatacgaagcaaacatgctgaatattaaaaaatattttatttaagttcattttattaatcttgctgattttgaagaaatgaatctctcacattcataatatgatttttcataaataacaacgaaatacatattgttgtttaataattatttttaaccatagaaccacatttagagtttatttataattcggcatctatgttatgtcgaaattttaacacgcagaatttaatgaaatcgtaattaactgctcgatgcctgacaatatctagcgtctcaagt

SEQ ID NO: 676 - DNA, 500 bp, Ctenocephalides felis
acttcccaaaagttgncagcgaaggatcctacaagggcgacagcagctttggagattaccaaatcaagagccgnggaattttcaacgtcaccatgtatgatgtgacagtcacttggaaaatcgaaggagcaactgaagaacgcgatggagaaacttacatgcgcatcaaacacttccgtgtcagcccaaaagttggtgatatgaaaatctatgcaagtggcttataccagatgaaggactcaataacgcagccgntgccttcatgaaccaatactggcaacctgccttccaggcacttttaccatacgcagaagaacacggagaccaaatcatgacaaactttgtcaacgaaatgttcttgagaatcccattcaacaaattaatgccagntgaataaagccaaaatttaaatatgtatataaaaaacatatagtaaataagcaaaattattttgatattttttggngattccaaccaaccaaattctatgtaggttggat

SEQ ID NO: 677 - DNA, 500 bp, Ctenocephalides felis
acgtatactatactctatacagctgtatgtgccacacaccaataatgtatcaatatgatacaaagaaccgatttgtaacatttttgtagggcctttccatgacgtcacgcacatgcattgaatgttttttttgttcatttagaatagttaggaaggtagccaaaaactcgaatccaaatatttatacgtatcccttttttttagtttgaattttgaatttgtatcaaattgatactagggacggatgcgggttaaacaaaaaagatcggattagtgatagtttcaaatttagcatggaatcattcggattatttcctactattaaagaccctacgagaataactaactcttcctcatattgtattgataattttttcacaaatatatctacggtaaattcatgtgtaattaataccggtctttctgaccattatggaatttcgctctctttgcctaatactactaattctacttcccatgtgnatcggnatataaaagaa

SEQ ID NO: 678 - DNA, 475 bp, Ctenocephalides felis
acactatgatcagctcaaaaaataacttgaacgcatatgataaactaaaccgnactcaaaattttaattaattaattatagattattgggtagatctttatctataatttaataaaatacaacttatatttctgaaagcatagcactgaataattatctgacaatgcgttacccatgtagatattttactaatgggaacaatttaaatatttttaatttcaaaattagtaatgcaaatatttgcatgttttgtgtttatttttaatttgcgggattaataatcctggcagttatttagacaataatgctcaaaaaatatctaaattacaacttgtttcattttttttttaaacacatctctacataaattaaatacgtaaaatataaattacatattacgaatatattttgtataaaaccgacacgccactgatggcatgntggtaattcatgacattaaaatgcaccccggggn

SEQ ID NO: 679 - DNA, 500 bp, Ctenocephalides felis
acaaagntattaacataattggtttaacaaataattntaaatatgatnattaaacagngcagggnngcagntaaaattatgccaagtgaatggtaatttcgagttcataaaatttaataaatgatgcngtcatatttgaagcatgtatgaaataaaaggcctttagagtaaatacaaatatcaaactttctatataggnnacaaaattgaaattaaatattcaaggaatatttctactcctagtagatgcgtcattttaacaaaataaaaaacattattaattaataaccataataatttaaaccattattctgatatcctaggntgcattgcaatgtcaaagctcttatcgctgatccccgagaaagctctttaatatacatatgagcttgatttctccctttgcgntttataagnaaatttcaaagatttgnttcgatattattaacatttgcaatatttatatttgatcacaaattagtgctaaaggtgaaattatt

SEQ ID NO: 680 - DNA, 475 bp, Ctenocephalides felis
cagcatattttatacgcaatgttacttaaaaaaatgttacatttttatataagaagaaatnaacattattatttattagtctgatttcatttatcttaatacgatattcctttaaaaagaaataattattaattttaatgacaaatcaagataatattttgacacttgtttatacaagaaatcgacttaagatgacatttattttcagggattatgagatttaaaatttatatggttccgaaaaactcagactcaagaaacattagtgtaaattgaagtgattgcaaaaaaattaaaattgaaaatctttgaattctgatattttggcataccttaggaaaaattgatgtatgtgtgtgtatgtttgtatgcatacgcggatacaactgttcgttgacgattcgcacggatcaaccaattttaattggcggcaaaaacgattagacatttgcacatcgagattttaataatatgt

SEQ ID NO: 681 - DNA, 387 bp, Ctenocephalides felis
acacaaaatatgacgagacacgactttaataaaaacatattttgtgcacatatttttattcaaagatttattttgaagtcattgttaatgagagtaattgatagtgaagattttagcttcttcataaaatcagataaaaccggtaaaatgaagtatcaagaattgaagaaatttttgtaattggcaaattcaaactatgcactcaaattttgtatttaaaaataaggcggcatcaaaatgtaattaaaaatttcataaatgtttgtaacatgagtgcattttccacagaatgtcccatacaaaaccggcatcacaaaaaagacatgtaagacataactaacataaaataccnttttctatgagacatcctcataactctcaactcaa

SEQ ID NO: 682 - DNA, 500 bp, Ctenocephalides felis
ncctattaatgttaaaagaataataatnangggtgagttttaccgatgggtggagaaagtgtataaatcgttttngccgatggatttggttaataaaaagaaaactgcaccacctgccacgtntttataatanttctataatctgcaataaaaatcatctgccatgaaatatgctccaaaataaaaaacgagtatatcgtgaaaaaatattttgaaagttataacaaatgcgttgcactttctagtttgattagttcatgtaaaaaataattattcacggcatttcaatacatgctcccaatatatttcaaattattcacccaaataagaaacacnatcgtgacaattgccaaaccattttagataaaatatgtaaatatatcaaatgatcattatatgtcttaacaaagtttataagttatcaataaataagaatgantttatattattatatctataaataagtagacgtgtntatccaccaatgaatttcaattatt

SEQ ID NO: 683 - DNA, 500 bp, Ctenocephalides felis
acttcccgtaacgtaattaaaaattcgaggaatattacatgttttcaagtagattattataaatactgtaacttatatatgatcacggaaaagtaaataaacaaaattaatcaatcgaatttaaatctgaggacattgtataatatttataagaattatataaactgaagtgcgaattattttgaatattcagaacaaaatttggcaataaaaaaaatccaaaatcatttgtttcgtcaacacaagcagaaagttttctgaatcattcaaatcggatgcttagttctctcaaaaactgccattttctgcacatttagtttggtatctacaaatcggctggacctgtctttgccaaaaactaatttctttctatttctattttctgcactcttttctccgtatcaccgaaacggctggaccgacttttgcgaaaaactaatcagcacatttccctatcaataggaatcgaatgttttttgaacaattcaaattggtgatcc

SEQ ID NO: 684 - DNA, 500 bp, Ctenocephalides felis
taagttaggagatttattttgttaatgtcaggtagaagaagatagatgtatgaaaggnngtaaggcttgaacaatatcaaaaaaattgtaattngtatttttcagacaatagctaatctgtgaaaaaacattttttaactttcccgtagttaatacgatagcattcagattcattttttttcatcttcttcatcagattatttagagggatggccagatgccanttttttgagacctttaggtctttagctcaccttttacaattaaatctttatgactgtttttaanttttttttctaaattctcaaatcaatcattaataacttgcgtaaaatttatgtctcttaccaaatactctctaaaatactactacaataatttcatcttaaaaaagattgcttataaacttcgaaatttcagatatattttaaagaactatatatataattgcatatgttctgcttacgctttgagcaaataactaacatcagtaatattaa

SEQ ID NO: 685 - DNA, 343 bp, Ctenocephalides felis; identical to SEQ ID NO: 109

SEQ ID NO: 686 - DNA, 436 bp, Ctenocephalides felis
acttcgtaatgctcaattgtaaccgggtttgtattccatgttagcatagcacttgtgcttgtaacagacttaattctaagatttatcacgtcagttttaatattaggctcacttgtcgttatattaatttcagcgtaatctacaacatcactttctatacgctcggcagtatgattccataatcctatttcatttttaattctatagctatttaaaatagttttaggaatagatttagaaaaaatacgaattctgtaagtcttcaaagggtgtaaattcgataaagatattttagtatcagtaaaatattcatcccttggtttatatacagtattgcggtcgcaatcgaaacattttatgctataaacaataatttcatcattcggttttcttgaatcttttgtagcattagcatcttttggttgtccatgtgagt

SEQ ID NO: 687 - DNA, 403 bp, Ctenocephalides felis
accgttcagtgcgtttataatgaatattatacagaagtagtattaagatagaattttttnccgcggaccggaataatatattaaggtaaggcaaggcataatatttataagatacacaagacattttgccttgaatattaatacatataatataaagatcactatcaaggtgaggcatattatttattaataacttattattattttaacgagtttttatgttttcgttttagggtgttatagcgaaactttttcaagttatcaagttaataatataacaatattaaggtgaagcatattaattatatttataagatacaaaataatttttttacataattatacttatcctaatttagccttattaaattttagttttttatttttagaatatttcctttgt

SEQ ID NO: 688 - DNA, 500 bp, Ctenocephalides felis
acacatctatatagtaattagatctataattataaaatttactcaattaaataattatgtaaatggtgcatattatcaagatataataggtttaaattgtgctagagattgtcggaattatactaattgaaaagtcgattactttttatttttatccaggattaaaagtaaagtttttccatagaatattcaaaaaacttttgcctcagattacccttacaaaagacatttgttaaacatatatcgtttcttccctaatttatatattaatagatcgatttataataattaataaatgcaatattggatcgagaactaacagttatagaatttttactaagtttctgttagtattttataatgtatatttcttataaattcaaactgatagtatctattatttaataaaagttgaaaaagtgactaatttgcattgtgtgtggcatactcgcaggtgcaaaataaatttagtaaaatttcaacacctgtttatatatcaa

SEQ ID NO: 689 - DNA, 450 bp, Ctenocephalides felis
actcaatataaatagaagcattattgttcaaaattaattgcactgagtgttcaaccgcgcgtcgaatttcgctctccgttctgctgatggacgctattgtggcttataattctcgtggctataataaatgattattatatagaaattcagaagagtgctccgattcgatgcgcatattactctttgagacggtccaacgcgaccctttaaagtaatgcctttcacaatagggatgcattaaactaattcgggctgaataaaatattttaacagtttgggaaaataaactactaaccgataattatctacacactatgaaatatttaaaaaaactaaatttttggcacttgtaaaatgaatgcataattgttcatttagtgcttttttatgcttaataattttgaaatctattagtaatgacatgacattgtgctttcagacaaattgctg

SEQ ID NO: 690 - DNA, 351 bp, Ctenocephalides felis
acattgcccttgatgttgccgatgttgtgattgacgtggaatttgggggtcgacagagggtctattgggggtatctccaggggtttgtaaccgtctttgatagctggcaagatacttttcattgattcctttatgcattcgttcaaattggggtcgtttcttttgcaaatcttgaagaaatccggtaagggtgcttcggggtcgacgagagctttcgctcggcagagggcggtcgtcgccaaaagcacaaccatcgccgtcatttgtcccattgtaaataaataattattatgaatagtttcacggcaaatcgtaatctcaattagcaatacnatctgcttcctggttgct

SEQ ID NO: 691 - DNA, 500 bp, Ctenocephalides felis
accaaaacctagataacataatttatcacgaataaatttaataaaatataaatataaataaaacaatacaatacaaatatttaattaatgcatttaattatatttagtcttatttgtaatgaaattaggaaatttttattatactctacggaaaggtaattaccctatgagaagttaaactcctcgagttcttcgaactttaccacacaaacttcatatcttatgtttgttcaaaaactactatttcgcaataaaaatcattttaaaaagaagccaaaaacccaactccaattcgttgtttcaaaggtgtcgaaattatagtaatttattcgccgcgtgtggcacaaaactaagttttaaaaaaataaaacagattcttccatataaaaattggtctggataatgacgggcgccgatcttcctcttggtaataaaatcttggtgaacttttgccaagaaagtcaataaaacgccaattnttttcattcgtatcattatta

SEQ ID NO: 692 - DNA, 500 bp, Ctenocephalides felis
acacaatggcaagtaattcttatacataatcagttttcatatatttacaatttcgtatattgatagttatagatattttagttaattcaatccttttcagttaaaaatcaaatgaactagtttattttagatcacatattttacaatatcacattcatttttttatgtttttcaaaactacactcataaaattataaacattcataaaattgctagaataaaaattgttaaatatgtagataaatcctcgtttctaatttttacatcttgattaaaataaaaatagttagttcacaattatttgtaaatggaattaaaataattctaataacagaataaaaactttaggctaatataagtcagtttacaataaaagttaaaatgttatgttgctatattatattatatatattacatcgcataccataactacatttaaacacaaagtattataatacttagtattaatgaatactaaagtgnattatgcataatatatt

SEQ ID NO: 693 - DNA, 500 bp, Ctenocephalides felis
aatctttggttttcatggtaatatatctaggtgaaaattnnnngcaacttttagacaatttttaattgacattgctaattaattaaataaataaaaatgacttaaagttatattaataattaataattacacaaaatagcgtattgagtcttcttctgatataactttccaaggactacaatattacatcctaggatatgataaaaatcagtgatgataaaatggttgtttgatcaggaatcatagttttgttttacattttcaagacattaaggtgggtgctagaatagtaataataatccatagcagaaaataaaaattatacaaatttcttttagttcttcttatgagtcttcaaatagaaaccaatttatcaaaaccaaatttttcaattttcgtgtttacacaccgtatgagaagtgacggtaagtggtcctcaggaagacgtncagaagtagtggagctgtagctggatctgtagctcctggtcatctcnagtc

SEQ ID NO: 694 - DNA, 434 bp, Ctenocephalides felis
tgaataantactagtnaaacttannttttcgttgttaccgaataaatacctgggngagnanntanngtaattacagactcctttttatataaaaaattaaaaatttagtcgaaatttatttatnttgtganatctatacttattttatgncnnttttaaatatttatntttagaacgtttgcataattatagttaccannttggaattacttataccagaantaanttaaaaaaaaacanttcagtgccttatgcaagtggnttataagggngtttatgtaaacagnaaaatatgtgcaatatatcaaactaattatctggcgtagagaantgaacagtnttctgggcaanaattagtnaacntttgggttgatatataaaccaatagaggnttatctttttgtgtcatataggtggagactcgcttgaaaagt

SEQ ID NO: 695 - DNA, 500 bp, Ctenocephalides felis
tcttgaattataagtgatcattatganttttattattgtcaatatttggggggtataaattatgattaaccatatgatttagaattttattcctcggcgtatataaatgtatatttgngtaaatnttgaattctaatttaagaacaggttaatanttttattttattgtnttcattaaaattccntnaattccgtataagcatctttacgactttattcagcgattnttcctattttttttatcagcttataaatgtcanttcttttgaaaagtttatatgattactttgaagtgatttatcaatattttcttaaatcatcaatttttcttttgaaaatcagggctggcggaaggcggngtctgctaggtctgcaaagccttagggcattatataaatatgttgacgagtgcatataaatatgtctgaaaaaaatcactctgcgtattaattaatatggattaaataacttaataatttttaacttccgatggnnagtta

SEQ ID NO: 696 - DNA, 500 bp, Ctenocephalides felis
tanttcttatacataattagttttcatatatttacantttcgnatggnggggngttatagatattttagttnatncaatcctttcagntaaaaatcaaatgaactantttattttanatcacatattttacaatatcacattcntttctttatgtttttcaaaactacactcataaaattataaacattcataaaattgctagaataaaaattgttaaatatgtagataaatcctcgtttctaatttttacatcttgattaaaataaaaatagttagttcacanttatttgtnaatggaattaaaatanttctantaacagaataaaaactttaggctaatataagtcagcttacaataaaagttaaaatgttatgttgctatattatattatatatattacatcgcataccataactacatttaaacacaaagtatataatacttagtattaatgaatactaaagngtattatgcataatatatttttaatataaaaat

SEQ ID NO: 697 - DNA, 454 bp, Ctenocephalides felis
acataattcttaaataataaaatgtgttttntnttttaaaccaanaaaaattttgggggggntttntataaaaaaaatnacacttattttttatttattatttcaataattaattaattaataatataccaataatatttatattttatcagaaattaaataatttaattaaatattgactataatctagatgtnataaancaaaattacnctttacaaagtcaattntttaaaattgaaaaattttnatttcctagtaataaaatataaaatcgtagaaataaatgnttgatagtggatcatattggataatatatgctcattatattttattatatatgtgggctctttaggcaaattaaaattctgcggcaaaancatattcatccagcaattcgcgagtttagaacataatattagaaattatatataacatttttaattcattcattgt

SEQ ID NO: 698 - DNA, 500 bp, Ctenocephalides felis
gggggntgacaatggngtgtaaanaanagcatgtatatanagntnactaattngatctatagngagnggggnggngaaatntactggnnagtcgccttanaacgtngngactgggaaaaattctggngttacncaatttaanagcnntggagcanaattnnacttttnatcagcntgggnaaatancngnanaggtnccgnattnatatgnnccttcccaatanntngcgnanatnttgattggtgaaatgngatgtgtntntgtagcaggctcattaagcagcgngannnngtngtggnnattnntnnantnggatactcnttatactttgaaaanantccttanagcatnggtnntaanannnttctttnattatntttnaaggtnaaggnttaaaaagcttannnncgtntatgtttnaaaanantttgntttcnttannngagantaatttatgagtnttatnngnttntagatntnttaaananntnaattatgg

SEQ ID NO: 699 - DNA, 436 bp, Ctenocephalides felis
attatatatntgcatgttaatttnaaataacctgtctgcanttgnaaattngggnggtttttcgttttaaatggatagttatttttgttactcaaatgttttatggagaattnctttttttggatatgtcgctttatcaatggcatattggaaaaaaatttaaaatcacttatgtttagagaagaactnagaaanaaaaatattatgttaaacagcttctctgaagtgggatataaatttttcaaaagcatngctgnttattgaaacagaagtatcctatgactatgttgcaagggattcagttaattaaactcaggtcaaggaatacgagagtctgaagatcaatttngaaaaattgggcaaaataaaaatatttcaaaagctagtagaaacatctggaagataatagaaacgagctgaataagcactgcatagt

SEQ ID NO: 700 - DNA, 225 bp, Ctenocephalides felis
cttatttactgcagcataccatacgttgaagatttatattattagttntgccaaaattttgttagaagaaaacattttagtatcaggctcatccctacactccttcaaccaattctttacgaacattaaatcccccaccccatccaatctcaatactaatgtagtatattctgnttcttgtaatgactgtgcttttcaatatattggacaaacctcccaatatgt

SEQ ID NO: 701 - DNA, 500 bp, Ctenocephalides felis
ngctaaatgtgcaaaaatgacagagagaactangctgtccgatttgaatgattcaaagaagggggggggcttgtttcaacaaaatanttgctcttggaaaaaaaattaaantttttattttnaaaaaaaatttttntttgtatatcgaaaatanttcagattttaattttgatttttggctaaagcntttaaagctcactaatatacnntttttnatacctttattcattatattgtcaatcaagacttataaagtcttataatacaaaactgcttgcttagataataataagaacaataaaataaagtaaacaaagcacgtnatangtagtagtanttaagaaaccaaacgaaanttataaantgaagtaaaaaatanaaatataantgaaaaaagacgaatatactttaaataaatanattataactttgcgattaaanttaaatanttcttatatatattaaacaatggtacagtatttatagtaatctatttaaaa

SEQ ID NO: 702 - DNA, 494 bp, Ctenocephalides felis
catggcatcgtgccctaatgcaaattgctggaacttcacgcaccgtaattaaaaggggggngaaataaaaataatcaataactgttttaaataatttcagaaagatcatcttctacatatataaaaataagtcgggttttccttcctatcgaaataactccagaacgcacgaaccgatttcgacaatttaatatttcgctggaaaggtaacaggctccgcaaggtttatagctaagaaaattagttgtgcatggcatcgtgctttaatgcaagctgctggaactcccgcaccgtaattaaaaattcgagtaataaaaataatcaataactgttttaaataatttcagaaagattatcttctacatatataaaaataagtcgggttttccttcctgacgaaataactccagaacgcacgaaccgatttcgacanttttgtattccgttggaaaggtctncggctncgcaggcttatagctaagaaaattagttgt

SEQ ID NO: 703 - DNA, 499 bp, Ctenocephalides felis
caataaagaattggatttanattatttacaaggtcattttctctattcnggngtttgtatgactccccgtaaacaagatcaagacctcctccgcaggtatatcatgtattgaagagaacgtcctcaacattctcgcagcatctttagttgagactagagaaaatgcaatatcagaaataagacatttattgtaattaaaatttattaaaatctatagcatacaaagtattaaaattaaaaaagtttgaccagcaatggcatacacattacataataaaattgcgttaaaactgacaatcaaattaaatcaattattcattagcggagatgaagaactccacctttttaggtttgaaaacttcaacacgaaatttgacgagaccagtaaagaattcagactggaaatttgtttcagtcaaacagattttgtagttggcagcattttcaatttcgtctcatcatccaagaaatctccattttggaagcacctgtgttgtaa

SEQ ID NO: 704 - DNA, 376 bp, Ctenocephalides felis
aagtattgacgaagttaagcacaaattactcaaaaatttgttaagaaacatattngtttgtaattttattccaaaagtatatacactggagaatataatttcaaaattataattgtttatcctgcatagtaagtcctgacgagctcccaaaatatgacgattaatatattacttaaattaaatatacatcgngctgtcggcaaagttaagtacaaattactcgaaaatttgttaagaaacatatttttttgtaattttattttgaaagtacacacaatgaaaaagataatatcaaaactgtaattatttagtctacccgggacgccctgaagagctcctcaaaattcacaagtgcaatataacataaattaatagt

SEQ ID NO: 705 - DNA, 118 bp, Ctenocephalides felis
ttctgtataagtaatttggttgtaataatgttcagtgttaacgaacngggtgagctgcatgagcaatgctctacccaactgtaaaactctaaatgttgttaattcgaactacgactgt

SEQ ID NO: 706 - DNA, 289 bp, Ctenocephalides felis
taaagnttagtttagatttaaattcatttaacttgnatttcaatgntattattattgcaaaataaattcttcaataatgnanatcaacaaatttcctttgtgttacaaaatttgnatgtattttttaactataataagtcttcaatatttccaaagcagtatgttctacaatgnaagtaatttaaaataagtattggtgnaaaattaaaataaatgaaataattaaacaataaatgctttatttttaattaggaaatcanatcaccagtatcatctctaagaaaaatgt

SEQ ID NO: 707 - DNA, 202 bp, Ctenocephalides felis
aaataatatgcgctcgaattgaaagaaatgcccgcgctcgtccgggatttgaacccgggacctcccgcaccataaccggaaatcatacccctaaaccaacttttggatttgccacttacgtttaatatctaagccgaaatcataaccctagaccaacaagccacgagttttatccagtgcatgtttgtgttggaaccaatgt

SEQ ID NO: 708 - DNA, 300 bp, Ctenocephalides felis
ttggtatagcctttccagaattactcatatactgngaaatacgngacngntgtaaacttcttgcaacaaagcatatatggaaatatgttttctctttaaatgactctttaaattggcgtttgntgaactatactttatctgctggntgcatactagttgattttcaactagttggttcaatgcccatcactagttaaaatcatttatgatattgaaaaagattaaaagttgattatactaaattattatatagccctcggctattttcgtgaatatttagtgagtaaaagcagcaaaagt

SEQ ID NO: 709 - DNA, 500 bp, Ctenocephalides felis
acattgatactactttgacatgtcggaantnttttctcagtttgttgntcttttgatnggggggngtcacaatatttacttattaaataattntgcgctatatctaaatgtatctttaaaattaatattttgcaaattagcaataactatcaatgagtagatctgctcatagtaagtagtatatatttttatatcgaatgttagtgtaaatgaccgttttaaatttacagttctagaatattaaacgagctttgtgaacaagggtgaaagatcaaaataacatcactttttaaactgtaacgttgacaatattatgttgaaatgatcaaattacataaatgagtcagcaaaatttgttgctaatattttgctcggatttttttgaagaatctagtntatatttggtatatatagatatatagatgtgncgtatacctatatgtgcgtgcgtgtgtgccaaattaacaatatattngccaaagatatgtatatgccagtct

SEQ ID NO: 710 - DNA, 425 bp, Ctenocephalides felis
accaaaatatggttaattattatatattaaattttttttagttaaatagnttttgtatgcggnggnaaacatgctttgttnggaatgcnaaaatagtgaacacaaagcttcattcngcaaacaaatagaagttgtgtattgacatatcttgatttcatcttaccatttacttaaatgttcataataatatttgcaagatacatagcgaaaaaaatcattagctatagcacaattttcataagttgttaattcatgttatttttattagaattcaaattttatcataataacacgattaaataaaataagcacaatgattttatcatgtataccaaaatgtcgcttgaaggtaatatctacatcttaaactagaaaccctcattaaaaatataataattagatttagtatttgttgaaatagtagt

SEQ ID NO: 711 - DNA, 500 bp, Ctenocephalides felis
cttcgtttaccaaaaaatcgctaattttntttttacaaacgtcaaaaaactactcanggggntcaaactttcataaattttcaaaactaaactacttgtcgtaaggccgtaatatttcagtaagttctataagaccatgatatataaagccaaaaaagtatcatcggcttaaattttttttcaacagttaattacaagaaaacaattacatgaaatctttaagcgctcataacttttgaacgatttattataggatattgatgttcccaggtgaaatattctaaatcaaaagatctttaatccagtataaaaagttttaagatacctcttatcgttcgcgagatatacgccaaaaacggtttcaaatttttaagtttgaattagttaaacggctatagctcgaaaaatattcatgacgtatatgaatgaaatatgcgtatttaaaatatgtatctgatggtgcaaaaagtttgtaatagctctnccgttccgnatatttt

SEQ ID NO: 712 - DNA, 499 bp, Ctenocephalides felis
ctttgcttcaaatatcgaagacatatttntgaagaaaatcttggcacacattgannngncnctgcacctcgcatgannntcacttgaatactcttgatgaaagagtgagaaatagaaataatcttcttgcaaangttcactngcatggagaaacctgaaatgcagtttatagaaatatattccacgcagtgaaaccanttgcacggactaataaacgcaacgntttcanttacgaccgcanttcacaaaaaaccggcgcttaaaantatactaactatttatatgcctnggaacgntctcgctttaagtgcgaancggcatttatcanttggggcncttaaatgaaatcttaatccaggataagggtcactaattacgcatggnaacaaaacagcaaatcggtgacgagcntaataanttaaaaaaaaacatnacaacccccggtatatgttaancnaaaaatntanaaaagcctgaaanttgggganaaattaaaacc

SEQ ID NO: 713 - DNA, 500 bp, Ctenocephalides felis
ntattggcttagaaagaggaanttaaatnntttnattactaantatatcaattaaganggggngnnagnaggngtggtagnaataaacattataatcaaggcgtnttgaattaaaagctcatattgntagaatgtannaacgcgcnataccttttctttttttagacaaaaatttataacgtaatatanttatnttaaaaatgcaaaaaatatttaaagcgaaaaataaacaactaacttcatatacatatatgtatatataaggatcttgcnagggcaaaataataaagattctgcaataacaagcatagcttctgttcaataaccgcattataaatgccnntttgntatttattacgcnatattagcaaaaatcactatgtgcgnnaanntttcttaaataattaactggcgngcttgcttaatatctataatanntttaacatcaacaataatgnntanttactnaaganttctaaaacanttattagaatattcgt

SEQ ID NO: 714 - DNA, 500 bp, Ctenocephalides felis
acgaattacatttttgttatgtgtagaaaggtgtcaaacanttcatctcttgatcagaaatannttttctttctagtaaatggatccaaaangngctaagaaagaagannttcctgagattataaattctctgaaaaaaanatacntttccnttatttatataatataaattatttagatatatgggatgacttctagaaaaaattaaagtggtcaggaatggngncattgaaagaaatcttnctatcggtatgntaattacatcaaagattaaacataactncttaactaattcatactcctatcaaaatatcttttagggatcgatatactggctcttttctacngacatggttatcttggaaattgatggaagtaaaganatggatctaaataatatgggcctcggccgggacaccctaaccgnatctgagatatcaatacctggcggcggtcgagcatgcattananggnccaatcgcctatagngggcgnataca

SEQ ID NO: 715 - DNA, 500 bp, Ctenocephalides felis
actcattttatatattctcggngggataaaaatataattaattantgtnggccttctacgggngtgcttttagaaaaaccaaaatctggtgggggggctttttgacccnccnttttgaggctttaaatttaattctttattattatggaaaanataggtggttnaaatcatgggnttagacaacatcggcggttcatttaagtatattatacattttggnccatcgcacngatncagtgattaaaaaatacagtcacgctttacaattaaatatcgcgaggtcgctaaaaataaagccaacaaagctctacgtgaatgaaaagncgggacctgagaagccgcntttaagcttggaagcgcgctggagttactgggattggaccactacacttaaagacacattgggaatccaagtagtccccattagctaaacncttcaaaatgctactataatggtgganggtangcttggctnggcgggacnccttagcgatntnnga

SEQ ID NO: 716 - DNA, 500 bp, Ctenocephalides felis
actaaatgaattacaaattatccgtatatatttanggaatattttacatatatggacangtggggnntggaagcttatttttgntnttaatattaactcttttatttacaactgtccagtaaaggacatttagtaaatttaagnnnttacaatagtccgccgagaagggacattgtatactacattgtcatgttggaaaaaacaactcagtantcgcncttcctttctatataaaattcacaatantttattattgaataattacttataaataatgattaagttatttctattntttttctcaggagagttgatagcttacatccattggcgcttaataaatgataaaaatgnataatcanttgatgaaataacttcatacaattattattacannntttaatggaagcttaatgaatgataaaaantataataaantgatgaaatacttcatacnatattattacaaccnctttatttcattctacactgggacgaac

SEQ ID NO: 717 - DNA, 363 bp, Ctenocephalides felis
tattatatgtattaaatgaaaccttttntttnatacctanntttagnggcaaatggggggnttngaaataaaaaggctttctataaatctatcgtaattgggtcatcatgaaaaaaaattgattccatatatactacnaccaantcgantngcaatattcacatatagctttcgatatgtccaaacaatcgaacatatataatatttanttcatatttaggtgatttaattatnggtaaaaagggtgtggcatgtttgaagagatatgtatatcgctatacaattaaatatccacattattatataaatataattttttgngcttatttatctttatcactttcagctttctttccaattggn

SEQ ID NO: 718 - DNA, 500 bp, Ctenocephalides felis
ggncantttattntcatttttatggataagntttntgaaataaatagtcaacagaaccnnggggngagntannncctttattgcttggaaatctatctatacaatagatttaaatannttagttccngnttataangtaacngcnggnccgncttcaaaaatatagaataanttcgataaggactagcgnttgtcanntttgcacaacaatcagccatctcngtaaatatccgaaaaggaaaaaaangnncgtctacgcntnagcccacanttctanatcgattttaaaaatacaaaaccgttcgaaagatattgggtgggaatganattgattanccttcngnaaanatctcttttattgacagnttcttgngaataactggcaaaaaaacncttgacgacnttatgaaactcctttcgaananatattataggctcaatggatatctaaaatanagggcctcacanacggttgcttaaaanttataaaggggaaaant

SEQ ID NO: 719 - DNA, 353 bp, Ctenocephalides felis
aaacagaaaaatatcaaacctttcatntntttcaatacatanttatctacaagngnngggggggngagggnngngactactacaataccatcactttttgcttttaattttattccaantacatactangagcngncttcnncgnctcaatgcctcattgaatccttcgcacaaagttaaatcagatcgnccttgtgcgcattgnaagaattgcatgattncccatgcgcaagggccagtagagttcttggccttggtaagcagnacttgcgnangcantngntgaggggcttgggcaggtgctgcttcactggaggaaccaccagagaagaaccagttataccggnttctac

SEQ ID NO: 720 - DNA, 500 bp, Ctenocephalides felis
aaaaagttcagaacttccaaaattttttnaaataaacccttcttcaaaangcnggggggggaagaaaagtaangggggnctcaaaaatctancntttttcgaactaatanttgcagaagattcggcagcattcacggcccngcccncancctttcagaccaaaactgngttcattactaaaacantnatgnancttcaccatgttcaattattctgaaaatanttatgcaataaagaactgcanttcatccagattctattacaatcagctgctcctcgtggaatctcaataccataanncttatgnggcagaatgaagcgcgctcgnanataaatgaanttacggccggtatttacaantttaactcgacantaattaaaacggattcatgtnccgagaaacttggaatcttacatataaanagcggnnctgngtttatttcgactcttaagnaacntcattgcgctaaccctagagaganatttatggtgactnaana

SEQ ID NO: 721 - DNA, 500 bp, Ctenocephalides felis
actttgaaaatttccaacttatttcatttcttgnggcatagttatcaacagagagactttctgggagaaagagccgctcggggcacgcagctgttttcgctgcttgatattttctacattgtttgagtctcttatttcattaacaagcgagttcttcaaaggaaattttcgcagcttgcacaattatatgatgtctcaacacacgacagtcaataatcttcttgaaattattaacactattctatcaaccgaaaatatatatttatacataatattatatgacatgatataggaaaaagaatttttaaatattttttctaatatagagtaggacggtgcacaattcgaacttaaggaactacatgacaacacataacatgtatcaaactatctactatcgaactgtgttcaataaaatgtttagttaatttctaattatatcctttcatactatttttctaaaatttatcatctgtcatttttatcacataggctgagta

SEQ ID NO: 722 - DNA, 500 bp, Ctenocephalides felis
acatcaatttgtcgctccaacgagcaaatacnnacaagccagcagtagactcaatagaatgtcgagtgatttcagatacaatacacttttgattgatttccaatagaatccaggtcgaacattttgcaaaacaccattcaatagaattttgaattcgtttgccatcgagccaataatgagttcgctgattttgttttaattatcgacgttattgaggaatgttaagactgttgacaaatgtgattagaatcttaactgatatatagttaaactatatcgaatattcatactatttgtatagacagtgatgtgctgacacccaggatttcacgaattttaattgtaaatttaagttgccaaatatgcatttttgtgggtaattttgagggtaatttattgcttttgtttctatgcagagacaagaataaaatgattcaaagcgtaaacaccaataaaatgctactatattcttacttggatattcttatttctattattgc

SEQ ID NO: 723 - DNA, 151 bp, Ctenocephalides felis
acaagtgttaataagagcacgtttgatggatcnactggttaatagaaatgttcgtgaaaatgttaatgtttactaataaatatatattttactaatgcaaaacaaaattatactaataaaaaaataacttatgtatcacttgatataaagt

SEQ ID NO: 724 - DNA, 167 bp, Ctenocephalides felis
acgcattgtctaaattgtaataaaaatgttntttaatagaattgttttcttagacagacattttaaatgtatttcgaaaatattactgtcacatgtgaatctgtgaaatgtgtcggtttcattgccaaagtcacatgtaatgtttgatacatttacagattcctagt

SEQ ID NO: 725 - DNA, 381 bp, Ctenocephalides felis
acaaccgttggcaaatatcaacttccacatcatnaccaaatgttttatcccaatcaggcgatgaatccaaatgattgaattcattacactgttcaggctgagtgtaaaataatgatgttggactttgaggcggagtaaaatgatttagttccactttatcataaatgcgttcaaattctcgtaaaagactctcagtgtcttgttgaataaaatctgtggtatcaaattgctgaggaaatttggtttctccgcttagagttttgttcataccagttgtagtagacaaatcctccagcagaggcaaatccactttctcctccagccattgagaaaatgcttcattagtaaagttatcttccagcaagcacgaatcagcaaagt

SEQ ID NO: 726 - DNA, 424 bp, Ctenocephalides felis
acaaaatttatattataattcaaataaatttaaaaaaataataatctgaacttttatatgagcaatcccatgttggaattatgttgcaactatttgaaagaaggcagctaaattaagttaagttaattgaagtttggaattacgttgaatataattttaataccttttaagacaaaacggaaactttcacatgaaacatgctaaatcgagtaaaggacttgtaagtcctctgagaagtgcaagcagcctttacaataaactaccagacgaactaaaaacaatgacagacctaaacagtttcaaaattaaattgaaaaattacataagagacaaatgaaacaaatgagttaaaatccctattttaaatctatattanttntgntntgtaaaatattaatcacaattnagtatnagttgtatgntg

SEQ ID NO: 727 - DNA, 488 bp, Ctenocephalides felis
acatacatacacatacacagacatccatttttntgatgtatgccaaaatgttcagaaaccttcaaaacaaaaaaagatcctgaaaaattatgaggaaaatcacacccaacaaattgatcttttttatgatttcaaaaattaataatacaatattaaattatacactacctaacttatgttttaattaagtatattttgttataggtaggtaatagttttcgatctttgacctaaaataatttttgaatatataaaaattatagaacatatgtgtaaatcttttaaaattttgaagacttttttaataaatcgcaaaaaagtggatattaaatttagtttataatcttttagttcttgttcgaatgttaaattaaattttggcaaagttaagtttccaagtcatttttattatttattaatgaaacaatattagcttttttggtaagaaaatcggcactttttggtaggtcaacatttattcttgtgag

SEQ ID NO: 728 - DNA, 290 bp, Ctenocephalides felis
acttttcatgatttaattgtatattaccttantaactaatataaatatatttattagggcgggtcaatttaaaggtcacttaggcacttgtgattttcggattctagggatcaaaataagatactttgctgaagaaaccacacctctaaaatgaattctgatgtccggtgcattgactcaataagggtttaattttgaaaaacctctcagggggggtcccagggtttgaaccagaggcatgagttgattggccttctaaagttagtcatacatttggaagcaattggggt

SEQ ID NO: 729 - DNA, 500 bp, Ctenocephalides felis
accgaactatacataatccaagaataacacanagaaaaatggcagaaattttccaagtcatngttcaaactgtttccatttacaaacaatttgaagatatatcaaaataaggttgacaatatctgacaatgagtgccattatctgttttttattgattttttgcagtgtattatttctgatcaaaggttaaaaaaagtttatcttgagaatcttgttcttatactagcacgttgtagacaaagtaaatatttcatttttatttaacaatattaaacctgtgagataagccaattaaaaactgctcatatagataatttatgatttcacgttttaacaagtttaaccaatctattcgaaatcaataatacctttaaatgtaaaaaaatataaaacaaagaaatgtaactggcttgatttatttgctaaaaacagctgataaacggcaaaattcttcgaatttgcacttgatctatataaaaatatttcggttttagcaata

SEQ ID NO: 730 - DNA, 500 bp, Ctenocephalides felis
acttcaagtataacccaacgattcacttccctntgtgcactttggcataaatatcccctaaaatatgtaaaacaggaaccagggcaccgtgataatgtaatcaaacgccggaaaatgatttttgatcgtatccatacctttatagcgaagtcgggaatccttgtgattatattttcctaaaaaaggaaagaagttctcgcatactgaaaagaaaagttttgtctggtggtccgatttcgaactttcaaacttattcattcggttaccgcgaccgcgaatgaaatattatgatttttcttgctcttgtccggaataagatagattgacttcgaatattaccggaatataagctggctgcgagtaaattgtttggatttgtggcttttanttatcgataaaatatgngcttnttngagnatngttggaanctcnngggtantnttcaggtcccatggntaccnttagnctaattattaatttngtagnnccaccaaaccatn

SEQ ID NO: 731 - DNA, 256 bp, Ctenocephalides felis
attaaagtaaattaaatataaatgagaaattgtccttattaaattattcactattttttaaatgnnctttggacattcttttataaaaattttaacaccgtttagttctagtattctaatgtcagagaaagtaaacaagccgagtgctctggatttttatctttttagtgcatcttgatgtaagttagcttcatcttttatctgtataataaatgatacactactgaaatatatttctatgtaattatttatatgt

SEQ ID NO: 732 - DNA, 500 bp, Ctenocephalides felis
acaacctgggctgtgaaaggtgaacttgaagaacgtgatggtgaaaagtatatggttattaaggangctgatatgtcgccagttccttcaaatgttaatatttatgccacaaatattttccctgataaagcagtcaatgacgctttcctagtgaccatgaatcaaaactggcgctccttatacaaagaggcgctcccaatattgagcaccctctggggacccccaatcaaaacaggaatgaactacgtttttgaaaaaatacccttccgacgtctgttcccagaatcctaaataaaaactgatagtgcaaactgaatgcttagaaacaaatatgtgattgtaatgatagttattagaacatgatataatatgttagaatagtggttaatatattatgagtatataaatttttacagatgttaatataagtatatgttaatgttaacaatttaatataaattttgtatttatatttattttgttatatacgtgtaaaaatc

SEQ ID NO: 733 - DNA, 500 bp, Ctenocephalides felis
cgatcaggcgtatttcacatagaaaagcaagaaagaatgttatgataactgcatcattgaagattcttcttattataattttatttgaatatttttgatgcaatattgtattaatgcgattgtgatacctttttacgtagaataattatgtgttgtcttaatgtcattgatttaaaaagtaaaaatcactgtcttatttaaattagtttgattctactgatgacaaaattactctcctctgctaaaattttatattactctctgctgatttttatattactacttctattttatgatttaattttaatttggttttaaattagaaaagcaacgacttagcccaaaaatggtctccactgacgaacgaaattactcttcgtcaaatacaagtattgttaacactatttttattctgagattatttttaaatttgaatttaaggtgataatgaactataccgacaagtttcagattcagatttcagttacaatagaactcta

SEQ ID NO: 734 - DNA, 251 bp, Ctenocephalides felis; identical to SEQ ID NO: 91

SEQ ID NO: 735 - DNA, 229 bp, Ctenocephalides felis
accagtgttatgttatggttatgttataccgtttaaaagacttcaatttccaatatagtgggagaattgagactcatcattttataaagcaattctgcatttagcatcccttatattataaatatatatgtattttggtgtaaagagtaatttaaaaaacaataatcaatatttttaggtaaacgataaatattagtatattacattatattaaaaaaatgtagagggt

SEQ ID NO: 736 - DNA, 333 bp, Ctenocephalides felis
acatacgagtatactaataaaatagattttagaactaatagaatcttattgcgatatatatgtgtgattttcattataatgcataaactttgttataaacgagcatagtcatttagatagtattcgtcatataatcaaatttcttctgaaaattgtcttaagcgattcctccccttaacaagcgaaagtgctcgaacgaaattactacttcaaaacaaatttaaaagataaggcatatagtcgcagaagttcgacaatgaaaggtagatgaaatagaaatgatatagggaaattaataaaatcattaagtaatctttaaagggtgacatttgt

SEQ ID NO: 737 - DNA, 197 bp, Ctenocephalides felis
acttctcacatgcaaagcgagcgctctaccaatagagctacgcccccgacaagtgacatcattttattccaagattctacgggttttatacttaacaatcactcacattaacatcacgaagacatgaaaaagtaagatttggaagttaccaagatataaaatagtaatatttggaagcaccgggtatcgatcccggt

SEQ ID NO: 738 - DNA, 354 bp, Ctenocephalides felis
acagaccttgagatacgggggcaattcttcggcttgaataatactgaaaaacgtcacaaacgttaaaatcactacaatattcgtgatcgccataacgatgttgtttctggatgtgtctggaagtcaaagtgcgtgatttgaatttttgttgcgattttggttctgtatccttagataaaatctgcgcccttgaccgtaatgccaaattcaagatgataaaggacaaagatgtaagtcgaaattatcacttctagagcacttgacatccagataaacaatgacaggcctggaaagaatcgcggtttacttatatgagaaggatgcgtggctgatgtgtcaccttgtccttggttg

SEQ ID NO: 739 - DNA, 500 bp, Ctenocephalides felis
actcttgaaagtaatgataaagtatcagtgagaaaaataaaaacacagcaatcaatattaagttacaagtgcaaattgaagcctgaaattagctgaccagtattgaaaatagggctcataattttatgtcaagtcagttaagagaacacataatctattaaataaaataaaattcaaaataaaggttaaattccacccttcttttaacactgctaatgttagtttgggatcgactaatccacaacaaaagtttatgagtagcaaaaattgccttttgatatttcacgaagaaaacatatctaataataattgtgcgtatagtttctaaagctaaataccatattctgtaatcatgtatgtaatatataaaaatattgttttttaaaaaccatttttttttaattttgaattcgaacgatctatataatcatagataaacaagtataaatattggtgttttttcagaattttatatttgccccacggtcgacgctagcgcc

SEQ ID NO: 740 - DNA, 293 bp, Ctenocephalides felis
accaatatttttactcaaacccatgaatgaaatcaaagaaattttcaaggacaaagaatctgacatacgaagatcaatcagcccaaatccacaaactatagaaagttaattatacaataatcaaaatttaaaaaaaattataggtataattgaaacatgtgctcacacttatgatcgttaagcacaatcgaccaaagaaattatgtgtaatttgtatttaaactaaactgtatttaatatatgttgtaattacgaaacttattatactttctagtcaaatctaaacatgttgt

SEQ ID NO: 741 - DNA, 124 bp, Ctenocephalides felis
actggtggagctttcgttttggtcttgtttttacttttttttataatatcatcgaaagcgctggacgctccattctcttaaaaactcaaaaactaaattgccctttttgctctttttcccccgt

SEQ ID NO: 742 - DNA, 278 bp, Ctenocephalides felis
accagatctaagttatttacagtgtaatctctgtaaaaaatgcacccatgaagtttatatcttgaatgtaagttgaataatgtagctattatttgtaaaatccctttaaaattaaaaataagacttggttttccatgtcttttatcaaaaatgtttcaatattgataaaaataatgttaaataatcagagtcatataaaatgagtttctagttttcttcttaagatcttgaaggttttaataaaatttttaaaaaattatgcgctttttaatctgtgt

SEQ ID NO: 743 - DNA, 500 bp, Ctenocephalides felis
accatcactccatgagttcgacaaccaactagaaaagacccatcaaccaattgaaaataaattctaacaaataaaaaaatattaatttataaataaaatattacctgccgtttttccataggctaaacttatttcgtttaaaaaatcttgcactgttttcttaacaccatcacttgtaaaaggtgttatgagcctttgcagatatgagccatcctaaaaataagatcatttatttaacaaattttatttagggagcattctagtctaggagtcaattttcaactttctgaaggagttgtttgttttctcgaaaaaatccgatttgccaattttattttttctcaacgtttcaagtcattctgaatcaattgagaccaaatttgaaaaaatatgtgtatgttttcatgtatgtgagccgatttttcgtttcgttttctcaaaaacggttgaaccgattttaaactagtggtgcatggcatcggccttatggcaaattgctt

SEQ ID NO: 744 - DNA, 500 bp, Ctenocephalides felis
accagtntgtgagatnaataaactctagcgtntttcgagaatatnngctatgatctttgnggggtaatnnactngtttaataatnncttatgcattacaaatgttaaaatgaaattattatgtntatttaataagatacatanaagcaatttatcttanaaatttataanctantctactaaatactgaaatatgaatttcctantcttaagattttactaaatcactgatntctgaattgaaatattcgctgaaaagtnattataatggacattttcacgtancaaangtatttaatcagtaattcttgaacattctcatttngcgtatatatttcatctataatanttacaaaaaaatatttacacatgccataaaatgaatgctccaatantcatttttatatcncctatntaattcntgtgtaactttatggcccttcatttgtattattttttaacatgcaatttnaaatcataanacttgtgttnataattnat

SEQ ID NO: 745 - DNA, 464 bp, Ctenocephalides felis
acattattgtatgaaaagcaaatttatttttgaactgtttgagttgatccacagatttcaataaaactttgtaatcaaattaaattagtcagcaaacttagcaattaaaaaattaaaataaataaatttattaatactaaattttatgaaatttcacataatttttgggatttatataatgtggtatattcatatgaaatgattaacagacatgaccaacgattatttgatcacagaaaagcccagtttagaatttcatgtatggacaattaaaaaagtttttttttaattatttatctgttatttattttaagattagtaatatgtaatgcaatcatttgaaattaatattctttatattactaataagagataacttatatgctcatacaaaacaatttatctgtttaacattttattcaaaaaacgtaattaatgtaaaattttaaacaaattgagacttg

SEQ ID NO: 746 - DNA, 500 bp, Ctenocephalides felis
acagttgacgttaatgaaatacctgcatatgaaaaaatgatccagctattgtaggtaatattacattaggtaaaaaactagacaatttaccaaaggttctcaactttaacttctgtctgtaatgattattcaaataaaaacctgcaaggccacaacaaaatcctgaaactgctgcaccgtatcgcagaggtaatctggaaaatataatttgatgttgaacatcatatcatttattagcattagatattatcattacacttttgactgttcttcccaattccatattaacttccactgatattggagagcttcgtcctcagttagtcgaatagcatcttttggtggttcacctttagaccttactaatgccattatattatatgaaatttactgctttattcataaatcatttgtgattttacattagtttcccagttaaaagttaagcaaacaaatatatttataccataagttttatggtactactttcaattttgata

SEQ ID NO: 747 - DNA, 500 bp, Ctenocephalides felis
acttttaaattttttgttatctaatttttcacattgtaattcatgttgcctgagtctcttttctaagttctggcaggtctggccaatataagagcaattacaatccaaacaatttactttataaactatatctttcttttttgttaatggggtttcatctttaattttggaatataaaaattttaattgttttaatggagaaaaagtaatacgaatattgtgttttttgaaaagtctttttgataattggttaaaattattgtcaagatatgggaaattaatgaaaaaagttttttcaggaacacttgttttgccaggctcttccggtttcttatcaaaaggttcaagtaattttgcgactctatttttaataattggacaaattaacttatatggaaaattattgccaagtaggatcgttttaactaattttatgtttgtatcataaaacagaggatcagataataaaatagcgtgatctcaagattagaatggtagaa

SEQ ID NO: 748 - DNA, 500 bp, Ctenocephalides felis
actggttgtgattgcttgaatcgagaagttaagaaaagcaacttttgtatgaatttcaggactggttctcccgtcagcagctggtcatgctggtcctgttcatcaacatctcgctagccataatgttcttcaagttgctgacgtagcggcggcctatccacaacggccctttgtggccgccatgatcacaggcataggttcattacagtcgtaagggaataaatcaaatagactttattaacgaccagcacatgtgacgcacagccgcggcactgttggcaataatataatcacaacaaaaaataaatgcaagaaaatcacaaaaaagattctagaatcgatcgaattcttcaaatcggaagaaacgaattcgccacgaaaccgcgtgactttggtttttcatttttttggcacgcaatggctgaaaggtatcggatgcgtccagataaatttgtcagtgggcgttttcagtttctagtcaatcgcctgcaggaaaagct

SEQ ID NO: 749 - DNA, 500 bp, Ctenocephalides felis
acacccaggtttgaaccggggatcactagatctgcagtcgaatattctaccattaaattatgtccccttgatcggtgacactcggcaaatagcaaatactggcaccacatcacatttactcagcaaatagttaaaaaatttgtaatactcttaaagcaaatagcaaacggtagcggtaaatcaaattatatcagctaccaatgtttttaataaattcaaagtctcatttactctacaaacatcgttaatagcgaacccctgggtttgaaccgggttaatagtgcacacgcgggattgaaccggggacctctcgatctgcagtcggatgctctaacactgagctatgtcctcacaatgtgtgttactcagcacatagcaaatacctacgccacaccacattttctcagcaagtagcgaaaattcagcaataatcttaaagcaattagcaaacggcagcggtatatcaatggcaagttgacgttatttacactgatttcagt

SEQ ID NO: 750 - DNA, 500 bp, Ctenocephalides felis
acacggctttgtagtagtcgtaaaagaattccgggtcgaagcgacagaagttcctttcattgttccccgtaatttctcaaaacgcccttttcctatctctcctgtatactttttgaatgcgtgcagcagcagcagggtcgaaggttatttctgcattcctcctacggcgtcgtctctgattggtattgggtctgcatgtgcgactagtctcgttccgagtttcaacgttttctttcggcttgattgatttggttaggtcttcgatctctttcggccaggtgtattaatagcctcaattctccggcaggacttgacctggaattttgtcagttttggagcaagcagtgaaggcgtagggatagttcttttgattgttgtttgttcgtgcacgtcttctcctcgcgatggagtcttgcttggccggaagttggtttcttctgtatggttcttaaatcgcgcaggcgttctgcaatttccctctcatttcattcacattcaac

SEQ ID NO: 751 - DNA, 423 bp, Ctenocephalides felis
acgtatttcagaccgttcaatccgggcgttgtctcgtcttacagcaaatgaatgagcttctgtcccaatttgcattaccataatggtattcatttttaaaatcggaaagaagaatattcaagaatccttcattgtatatgcaaacaacaataaatgttgctatttcaattacccgagatcgggaatgaatatgtttcggcgcgaaaatccaaatcaacgagtttagagactcattattgttctgagtttctgagcctaaacatcgaattaataatttatttgacgataaactgtcataaattggtctaatgacttcctaatgccatttgttctattagaccttgcaaaaccagtttttggagaccgcgtcagtaaagtgcctatatctttgaagataattcaaattttcaaaaatcttctcgt

SEQ ID NO: 752 - DNA, 500 bp, Ctenocephalides felis
acttatatatctatttaagcacggaacttatatacgactgaaattcgagttcaaatagaaatctcgctctacatatttatatttatttaaataattaatatgtttcagtgaaatgtttttgatttttctctagttgtgtgaacacgaaaattttaaattttatgctttattgtgtgtagatgctctgtcactttcaatttgcaattttgaagatttagaaatatagaagatggaacatggtttttgtagttggtggtttttaaatataaaagcattgttaactttccgttatagtaatgaaccaaaaattaaaattgaaaatgtttgcatttctagatgttttgaaggtttctgaacattttggcacacctcagaaaaaaggatgtgtgtgtgtgttttgtatgtgaattttttcccacgttttcgggcgcatggatcaacctatttaaatggtaaaaaaaattcgattcctattgataggacatgtgctgattcttttg

SEQ ID NO: 753 - DNA, 185 bp, Ctenocephalides felis
actatagggaataaataaatggcagctttttccttaggtcgccttttcaacgtccggattttcatgtttcgaattatacatggcgctatgtatattccatactgcatgctcgcgagctctttaataaaatattagtgttggcacgttgcacaagattggattcgatttgacacagcggcagttgt

SEQ ID NO: 754 - DNA, 376 bp, Ctenocephalides felis
actagatgttcatgaggaatatttagcgtaaaggctggttcggatatatttgaataatcatccatatctatcatattagtatagtcggtgcattcgaaatttatttcgggtgttttgtaatctctcaattgcgtcaggtcttccacattattacggtaatataagatttttcttatagctgaatctcgtatttcctttttattatcaaacaacattgctaataaaatattttccgagtgagcatagtatgcgttttctttagcaacattgttcacaatttgtcttaaattcgagtctaaatattgcgtccagctaataaatttataaaataatatactaccatacaccacagagttgtaatatttaatgttaaagt

SEQ ID NO: 755 - DNA, 492 bp, Ctenocephalides felis
acttttactaatattatgatcataagctccactttcacgatcttctgcaagggtnattcgactgcaagggtcgaattacataatgggaagagcttaggtaaaaaaataaatataagtctgttacttatgtataaagtataaaatttttatatttctatgaagttaacaatttagaaattaacttactttttatgaaataagctatttctttcaattaaactaaggctttttgtgcaatacttttaatacaatgttattttttttaatatttatgcagccagttttgtaaattctcctaatcaaaagaaaccgcctcttgctatggatatcgaaaactttaattgagaaactaaaaactaaagaaactaaaatatgcttcaaagtaattaaagaagttttttggtttatgaaaaagtttataattatttatttagaagtttatgaaaattcatataagctaataatgaaagcaaactaaatattattcgaatg

SEQ ID NO: 756 - DNA, 360 bp, Ctenocephalides felis
accaggtgagaaatggtcgacttacttaagaaagccttagagtaattaggttaatgnataccaattgaaaagtagcttaccataacattgntgcattttttgaaataataagcgcgttttatttaatattgtttttttaaaagaaatgctaaaagctttatgtaaggaatgtattgccaaaaaataccaaatgaaatctagtcaacattttattatatcaaatcattcataattaacttagtattcagacatgacaattgagctttgattattgtaagcttttctacaggctaatatattattttaatataattatttttgttgcttgattatcttattggtgatggattaagtttttgt

SEQ ID NO: 757 - DNA, 207 bp, Ctenocephalides felis
acaaatgcaacggaagtgcgttacggccgaactgtaagtcattcgctctcgatgaactcattttaatacgggtcgattgtgattagtcgtcgtgtatgtgaatagagatctgtcgttgtatgcgtaccggcgtcaacgttgtatgcgatccgatatcaacaagaaaatcggcatggataaataaatattttaaagttacatcgtagt

SEQ ID NO: 758 - DNA, 500 bp, Ctenocephalides felis
caaaaattgaaaaaaatatctacaaatggntacatatttttgaaattgtctagaaangngtaaaatatgtagaaatctaaaaatatctaaaaatccatagaagagtctacgtataaaaatcattctcacgaatacaatttacctgccaatgttgtcgtgtatcgtatatttttctgatccaatcttgacaaatgtttcaagattgaggtcagattttttataaaaaatcattataaattatttcttttccacccctatttatgacatttttgaagaactgacaaaactcaattttaaagcttctatgttttttattttttgagaggagcaaaggaaattcttcatcttcctacaaaaaaaaacaataaaaataatagaagtgatactctgcaaaagaagaaaaactttgttatgtgaaaatgagattgcagtgcttgcgggcagtctgcaagacctttaaagactatgcaacactttcaaacagtctacaatgttctaat

SEQ ID NO: 759 - DNA, 500 bp, Ctenocephalides felis
acgtctatttagcaggctagagtctcgttcgttatcagaattaaccagacaaatcactccaccaactaagaacagccatgcaccaccacccaccgaatcaagaaagagctctcaatctgtcaatccttccggtgtctggacctggtgaggtttcccgtgttgagtcaaattaagccgcaggctccactccttgtagtgcccttccgtaaattcctttaagtttcagctttgcaaccatacttcccccggaacccaaaagctttggtttcccggaagctgcccgccgagtcatcggaggaacttcggcggatcgctagctggcatcgtttatggttagaactagggcggtatctgatcgccttcgaacctctaactttcgttcttgattgatgaaaacacatttggcaaatgctttcgcttctgtccgtcttgcgacgatccaagaatttcacctctaacgtcgcaatacgaatgcccccagttgtcctattaatcattac

SEQ ID NO: 760 - DNA, 338 bp, Ctenocephalides felis
acaatattttttcaaaagggtcataaaagtgttcgttttaaataggtattttattatgtgtnatataactttgataaaatttcaaacgcgtatttatacatcagcgtttgcgtatccaccttaatttcaatttaattttcatcggttgattatactgaatataataaagattttgtgtttattataatttaagtataaaattgtagacaataatattctacgattcaaaaatctataacacataattgatttaattttagtttaaactataaaaaaggggaaaaactcacgatttatatttcttctagtaagtgtaagcttagatatgttgcttttgt

SEQ ID NO: 761 - DNA, 348 bp, Ctenocephalides felis
accaaaaatcttattgccccaaatttatnntatctaacactagcctatttttatatatttttacaaagaaaatgcgaaagttatatatattatagatatttttacgtctagtcgtttttatataaatactcaatatatcatgaaataaatcaaataaaatataattataattctatatataatgaatcaaatttaatttaatttttgtgacatttattgctatttctgagatcgtgtcataaatgatctcaaggaaattttcgttggcgatttgccatgatttaaattaatgttgcttaaatatttgcaacgcattttccttataaatagtctaaattagaatcaagt

SEQ ID NO: 762 - DNA, 372 bp, Ctenocephalides felis
accttctacattactaaaacctctgattttttataaagtagatttattacaaatatttcaaccatcgacaaccaaatatcgtgtcaaaatcgatattagcttttgaagatattctgaaagtaaacagcgattccacgtattttttattagtttcgggaagatttttatttggctataaaagtgttttgattgctcgagaacaagatgttatctcttcacaacaatctttacagataaacagataaactgagtcttcgattaatggcagtattgaaatgaggttttatataataattagacacgaaggcaggtccagcagtctgagcatcagtttcgtctatgattgcaagtatatatagggtaaggcgaggt

SEQ ID NO: 763 - DNA, 500 bp, Ctenocephalides felis
acggagtgtaaaatattgttgaagtattttgaaatttattaatttattcgaaaaggngatttcattaaataaaaatggtttacgaaagtgacttttacacgacccgtcggccctacagtcgtccggctttgtcttcatactccgtaacgacgccgtcccgtcattacgtggtgacagacactccatccagaccaagggtagcggaagagcaatattcttactcctaccgcagccagcaggaaagatcttctgcagatccctacggaaggaactattcgacaacttccaccaccgaaagcacaagacgtgcaggcggttatccaggatctgactattcttacacgagcgaacgctcatccagaactggagatggaccaggtagctacagatccagctacagctccactacttctggacgtcttcctggaggaaccacttaccgtcacttctcataccgtgtgtaaacacgaaaattgaaaaattggtttgataaattggtt

SEQ ID NO: 764 - DNA, 302 bp, Ctenocephalides felis
acgccaccacctcctgggcattcaccttcactgatctttttcaattctttgtgttgttcacngttataattcctcataacgcattcatttccaaatgatatcggtttttcaccatcaacaccagcgcatacaggagtgtagtcgtctgtgcagattttaatgcatggtggatttctgttttttgcgggggtagcttcgattaggctagccaatgccacaaataaaacgacagccaccaaataaagcttcatccttatttatcttctttccaaaaattcgatgttgtctctcagatatttcct

SEQ ID NO: 765 - DNA, 500 bp, Ctenocephalides felis
acggaaggtatttatattaatgtcaactctcaaatgcataagaaaagcttatggtctaatattgccactggaaaattgtctaatttaatattaatttcttctatgtttgtaaattcgttattacatattcctgtagtaagattaatatgagtatgggtttaatttagtagtgaatactatagtaaccctataaacatagacattaagttgatcaacgcgtttatatcattagatctttcaatgaaattagcattaaaaattttcaaataaaaagcgtcttatattatcgcagtaaagtttccttaactctccaagaatgaataaactgacgcattaggtgatctatacatcaatattacagcgcgttcattgatatttcgatgttatttgctcacattcaacatttttaaagttttttcattctcaagagtttccggcgatgttcccggtgctagtcgaaacacatgcaggtgggctttcctttctactcccgtgatatt

SEQ ID NO: 766 - DNA, 500 bp, Ctenocephalides felis
accagagatgaaatttgcgtgcatcacccggaagttttggaagacattgccaaatnngaatgactacaaagcggtttcaggaattgaaaacgaaaacatagaacaaataataaatcaagctgacctgcaaaagtattatccagaaattataaatttatacaatacaatgcacgtctttgcgttacctctagcacatttgcagtcttgtttcacgtttaatattgaaaatattcttaaaaacgaaaacaatatcagttatgccaataaaattaatggatttatcgaagaattacaaaactttgtagtaatagctcaaacgcagtctaaattggggccaaatgaggaactcacaactttaaaagatgtaagcgatcttaccacacttgaagatcttagtcataaaataattagtgaattagaaaaaagcagtaacagcagtgatgaagtaagttcatttgtaaaatcattgaagaccctaatatgcttgtgaattctataaa

SEQ ID NO: 767 - DNA, 479 bp, Ctenocephalides felis
acattttccgcaaacatgtttgttgcaactttgacacgtgttattagttttattattattacaaagtcttatttggcaaaattttcttttattactattggtatttgcaagatgtctgtgggtcatcattttcctttgattttttttgtgttgatgtcgtgtagtccgcggaaagctgttctgccaattcaaacaaaaactgttctctaaggatttgttttctttggatttttattcctgtcgcttccttgtaaagaatccaggcatttatcgcagccaaatccaaaatattgaaaaatatttgcaggggtcatctattggattggaactggatttcacggtatattttctttacctttgatctgccatgtcttctttgctgaccataaataagtcattttcaatttttttgctcataggccccacgagcatataaaattccaataaatgcacgtatttcggtaacgatttgctaatcg

SEQ ID NO: 768 - DNA, 500 bp, Ctenocephalides felis
actcaagatttgttacaatactttataagacttaacntaataatacgatagataacctattacctatcatactatattatattattgtgtatcatcgatagatatctattatctatcataccgtgagatacatacaccgtcattaacttgtaatatacctacagaccttttacttcttataaatactactgtctaatttatatattcacctatattatataggtttaccttacgccctatgtattatctctacctatctattgtctataccaggaattgaacccgggacctccgcgtggaagtcgcgcaccttaaccactaccctatcggctacccccattaataatataatatgggacgcactgttgtttccgcgggacattttctaattaattagataattaatactaaggtggcgcgacaacacgcgaaaaaagacggttgattgtagcgttacggtggccgagtggtaaggtcgtcgcgtgccacgcggcggaccc

SEQ ID NO: 769 - DNA, 500 bp, Ctenocephalides felis
acaattatgttcttatttaagctttgcaataattctntagactgtcctcttattctcaatcaactatcctttaatgttccaaggctatcttcgcgttcacaattatttttcaattatcccacccctaaatctaattctctcttaaattcgccaattttactaatgtcctctaactttaacttaattaataatgaaatagacattcacaacacatcacctaatcaaataatctccatctgcacaagttaatctttttattttctttcaaatatcttattattttctgtttataattattattgttacattctgcattatatgaaattttatcttagcattttatgttactaactatatattgtaattttgtgtatattttaattgttattcattatgtcaaataattgtatttttgagtcctcttggagaaatctgtgggctatatatttaaataaataaataaataaataaataaatatatgtacaaatatacttataag

SEQ ID NO: 770 - DNA, 106 bp, Ctenocephalides felis
acaaattattgttgtgtggtagtttactanttnagagtaaagtaaacgtaacacacaattgcatatgcatatattattattcttatatacatataaacaatagtgt

SEQ ID NO: 771 - DNA, 453 bp, Ctenocephalides felis
acataataaatcgtgataaaattaattcaaagtagcacccaaaaaccaccgaactttgcacgaaattacgttttgttctcaaaaaagaaaaaggaaataaatcaagatggtccaaggcgagaaatacctggcaaccaagtccttgtctattgacaactctcacaagaagagtggattcgacgctgtgcaaaaacgcgaggaggagaaaaggcagcaggccaggaaggagcaggagcagaaagctaaatatggagcctggggtcctgttttcaaagacagggaaacttttgccagcatgcacttctgttgaaaacataaaattttatatggaataataaatttgttttataaaatactagcatactaacaaaaggactaacatgattctaccttggacctaaatacaatactcaaataaattggaacaaaacagagatggcaacgctttaatgt

SEQ ID NO: 772 - DNA, 182 bp, Ctenocephalides felis
acaaagccatcactccaccaattacgccagtttcaggccacatcaaccccgctttttttcggccttatgacttgttagtttgttatatctaaatattaaatttatgttattcaacaataagtaaaccccacaacgtgaacaacactgctgttctttgtcctgaggtaggattcgaaatcggt

SEQ ID NO: 773 - DNA, 500 bp, Ctenocephalides felis
acaaaggtccaattgaacttcaagtaattactntatttaaaccaaatgaactacatcatacatgtaacatgtgtaaatatacaactacagttttttttctaaaatttgtcatatggcccattttaccccataaacatagataaaatgggacagtcaggggacaacagttcttctaatgtctgattttacaaaataatagctaaatatttaatcaatgaaaaatttacaaagattatattgtatatgacttagatctggtattttatcagaagtatttatgagcagagttggtataattattaatttttttccttgtaaaattgcttttttttaactgagtttacatttttatttacattttttattatatacttttttgccagggtaaaggttcagttggttctttttgccccatccacatgtaagccattatagaggttatatagaaacatctgttgaatctaatttgaaattaacaatagattttataaaacaattca

SEQ ID NO: 774 - DNA, 500 bp, Ctenocephalides felis
aacatttctgtgataaataaactctagttgattcgagaatatttgttatgatctttgtttctaatgcacttgttaataataattatgcattacaaatgttaaaatgaaattattatgtttatttaataagatacataaaagtaatttattttagaaatttataatctattttactaaatatgaaatatgaatttctagtcttaagattttactaaattactgatatttgaattgaaatattgctgaaaagtaattataatggacattttcacgtagcaaaggtatttaatcagtaatttttgaacattttcattttgcgtatatatttcatctataatttttacaaaaaaatatttacacatgccataaaatgaatgctccaataatcatttttatatttacctatctaattcgnngtaatttttatgggcccttcatttgtattattttttaatatgcaattttaaattataagatcttgtgtttataattaatttatt

SEQ ID NO: 775 - DNA, 473 bp, Ctenocephalides felis
actacgatcaatggtgtgatagcttcgaattaaaatgttgatactatcgagtatccaaattaaatttggaaattaaaaaatgttgtgtgttaattgacagaatctttacttcttctaaaagcaaatgaataagttatatgttatgttacttataaaataattaatatttttaaatacaacaataatgtctgcattattatcttaacgatgggaaaatgtagtaaaagtcaacagatctagttgaccgtatcactcctgattattaaccatagggttaataaaagtattataaattcatcaaaatttaatattaaaaatgatcaaacaatactgatcttattatgatcatacctaattatacatgtgataatataaaatttcaaatcaatacactagcgaatactattattagtttatcatagactaatgcattgattaaaattcagggccatccttaaattaattaaaaactg

SEQ ID NO: 776 - DNA, 499 bp, Ctenocephalides felis
acctttncacagcctctcttangtctgatgttagacgttcngctngcaacttttgttgggngtntcctcggcncncaacgngagntagcctttgaagatctctacttgnagctgatattagctgnattgcactgaanngtggcgtatgactgnnaanannacnnnnnnncccttnccagtttnntatangcatntanataattntaagncatttttataanctattatananattatctatnggggagncagncataattgaaaccagttttttctatcaatcatagatgatgtaatggtctaactntcaatagaactattgaaagttacnccatngcatantgaaaattanactattcaannatnaaaataatacaataattatgnngnagcagntacnttttaactattgatactaatgctactttaatatcttaancaactaagtnactcatnttgctagaaaatatctaatnaaattatataaactnacatcttn

SEQ ID NO: 777 - DNA, 500 bp, Ctenocephalides felis
acgttcacctgccgcgcaatcacatcggctggtcaagtggaaacctcagcaaaacttgttgttaaaagtaagaaataagacatggactcgctctaataattgttctaacatttaaattactattatcactagtcttgctatatttatttgctttgttttcaatttagtatatcaatcaaagttagattaatagtagtttttcgagctatttaaaaatgattttaaagcagtataaaaatataactctaataatattattgcgattgatatatttatataaattatttattctatagttcaatttaatagctattaaaagtatattgtgaatataaataaaattgcttgccatagatatattaaaatatagcttaagcaactgtctttatatcatattagtaaggtcctaatcggtcatgatattttgtggtgttgattattattctgtgctgtaatcattgtccaaatgatatctgattgtttaacatgatacaaaaatt

SEQ ID NO: 778 - DNA, 188 bp, Ctenocephalides felis
acatgcgtaaagtgcaatttaaataagaattaaagacctattaagaatgttttatagcaccttttatgtaatttgcataatcatggatactagagcttttatgtataaaaccttattcggccatttatttatatccagaaaagtaaaaaaataagctggctctaaaatgactattatttataaaaagt

SEQ ID NO: 779 - DNA, 500 bp, Ctenocephalides felis
accagatagaaaaagttagaagtatttgatgataagttgatgttctcattatttattttataatgacataattccagttaatcattccaccgttattttgatctgactcattcctaatttactaaaatacctgaaacaaaattccgtccattaatagaacagataaaaaatcaatccattactaacaggcggctttcgattttcgttacaaaatgttttaatgttactttcaaaagattattatttgttgctttgttctaaatatggtttccgttttatcggattaaaattggaattaatttctaataaatgtctataatttatgatcattttacaaattgatctttctctcgaatcgaatggacaatgtgtgtcaagaacaacaatagtcaagatctattgattggattcgattggatctttatcgattattatcagtatcacacctttggataaagttcagaaatgttgtaattattgtattaatatttatatgttac

SEQ ID NO: 780 - DNA, 434 bp, Ctenocephalides felis
acgcacgtgtcagaattggttgaaaaaatcagtttacagaaattttacttaatcacgctcattgaacagtatgcacaattttctcgtcagaatcgaggtaaaattttgctgtgaaaagttgaaatgcaactattttttatactggcttaatcggtaatatattttaaacatattgtttgagaatatgtggttgcaacctaaatgtaatattcaaagatttatatgcaaaaattctgccaattctccatgaggagtatattcgtcaatcacagttttaagtaaaggtgatcatcgttctcgtcgagctattaaagttgatgatcatattgtagaaattttatacgtattgcacacaataattatcttggaattgttattagacttaaaccttttttgaaggccatccttagtgatggtaaaaaatagagtcatga

SEQ ID NO: 781 - DNA, 500 bp, Ctenocephalides felis
acgggaagttccagcaatttgccttaagtgatgctatacaccactagtttttaatattgatgaatatacgtatttaattgaaatgttgaaacttgtatatccaatagtaaataattcgtatttgcatttctatttgaattacagggcttgaattgagaaatattaaatgttttttgaaataatgctttgaaatattttgattcgaaatattanatccgaattaaaatattattagaattattatttttaatcgttgaatatgctttttaattatttattcattgaacttaaaagcttcttttcacaaagatttattaaagagcaaatatgttttataagtgagtctacttcctgaaaaatgtcagaatacttgcattttaatatatatttcagctaaatgacaagacattggcaaaacttgtattcacttattttaaattctgaagaagacacaacatttaaaaatattgtcgatttcttgnataaattatcgcccttaa

SEQ ID NO: 782 - DNA, 500 bp, Ctenocephalides felis
caaactttaatagatgcaagaagcaaattaggatcaaaacccaatttatctattttttagtgcagaagatttttttctgatgcattaatcttcatacagttttatgttatataaaattataagtaaatattttacctcaacatcactttacagaatttcagtaaaaattgagcaattaatacaattcaatattgnaaatactcttactggttggagagcggatagtttcaaaaattttctaaagaaaaattgagtgtcaacccgatgttctatttaaaacggattcgttatatgccatttcattaagatcgaaacccaatttatctatttttaatgcaaagatttttttctataattaatgtattgaccttcatacagttttatgttatataaaattttaagtagaacattctacctcaacattacttaacaaaatttctataaaaattgagcagttaatacaattcaatattgaaatattcttactggtggagagagga

SEQ ID NO: 783 - DNA, 500 bp, Ctenocephalides felis
acttcttttgtaagaattaatttgtttatatttatatgtatgtatatgctaaaattacaactaggtatttataaatcagaagagcttgttttaaaacaattcatatttcgccgactcccctattgaaatataaattaaaattttgctacgactagaacgcgtggtttcttgcaaagtgagatcattttataatgataaaattctgaccgaaaattatatgtcgaaatgtcagaccagaattagttgagtgtaaacggtttattcgtctttcaatgtccggcgtaagtcacaatacaatatacgttcactgaagcgatacgttaaaaggtgttatagaataagaatgcatttcaataatgaataatacagctaaagattgaattatatcccactttgcaacgcatatttgagttaagagcagagaccgacggcagacggcagagagcgatgtccatgccgtcgtcgtgcctgaaatattattattccacttaacatctgaa

SEQ ID NO: 784 - DNA, 422 bp, Ctenocephalides felis
actttcttcccaaaactcgactttttatttgaaaacataattactcggttgtagtaaacttttntaaaatatgtaacaaattacttagcatctttctaaaatttattcaaataagtatttaaattaaatcttcctctataaaatcgttttatttctactaatttccaataaatgacttctcgctttgctgttttttatgctgngggacaaacaacaaatgacatatgaccaagcgttgatatatgcttgagcatgatatgtcatgaatgtctttattgtaattatgcctaatgccttaataattttcttgaaaatattttataccactattccgtttccaaattcatctaccacgagtaaggtatacatttgaaagccataaacaatagttccatttgtatcatcaatgcaatccctgtcgg

SEQ ID NO: 785 - DNA, 500 bp, Ctenocephalides felis
actataccggtgcntaccgtggcaagatgaacgtcccaaaacgtcgctgatcaaattaatagtcctcgtggctaatttatttattctggaaaatcgtgcgatttgtttgtgttcacaaaatttccgtttaccaaattttcctctataatgttcggagtgttggccgccacctcgatttggttactattggcatgggcagctatgctaatatttttccttccgttgatgttcgttgtgttagcagttttgccgggactgccattactgattattcgaagggtgtgctacgtgcccttcgattcgatttaaatttgatttcttcaattaaaaaatcaattttaaataaggcagtgttctttgaaatagttatttaatcgtgtcatttcatagtagttgtgatatttatattttttaaacatatatcttctaatcattgataagtatgatatttatacatagtcttacatattaaggtataatatataatagattagtcgtat

SEQ ID NO: 786 - DNA, 500 bp, Ctenocephalides felis
acaattgaaatatatcacagtcaacaataaaactgatgcaattttagcacaattgaagaatgaaatccaaataccataaacaacgcttaacaaccacctagctaatgatgagctaggtggttgaatattggtaagtaatataaataatgactttatcatacaataatattactttcactcatcaatttgacacaatttcccaaataattataccaataactgagaaaatttttgaacaaatttcgacagttggttatttgatatatgttatgtgctgatatgattataagtgtatgatatatattgggatgcttaatggaacatttcactcaaagatgcatctaatgcagctcaacaatcaatcatgaaagatcgaccgcaattttccatcttgataactagatgtaacaaaatcgcatttttgtttagatatttatttatatgtaataacactgcaatgcgtgattggatatcaaaatcccataagcgttttttataat

SEQ ID NO: 787 - DNA, 500 bp, Ctenocephalides felis
actgaatattgttgtggtaattatttctggtacgaatgattcctttgtggatacggtagtaacttcttgtagcacccgatctgttatgaagtcggggatatctttgtctgcattcatatctggtggtggtgcagtatggcctggatttgtttctcttgggcctgttgtatgaatttctttatcatgctccgttggcaaaatcggaatatcgctacttttatttttaaaaatctcttcatcgtgaccagcaatattattattgttgttaccattaatatttatatcgattccttctgtgatatctgaatattcatcaataaaatcatcggagcttaacgtgtctggagttggagtcaccttcggtttaaatgtggtcagacgtggcaaaggaggaaaatcgctttcttcattcattttttctgtcacattcatgattttcacaatcatattaccgtaagttgtttcttcgattcctgaactgcttgataatgcctcggccg

SEQ ID NO: 788 - DNA, 436 bp, Ctenocephalides felis
ncatttcaactgagttcattaattgagttcattaatncgtgaatgccaaggcatttacctatatcctattatgtaaaataacgatggctgcatttctttgaattacaatcgttattaaaactaggcaaactgaaatttttgcccttggattgcagtgcttgagtgaatcgcttttggcaaatgggataattataatcatatcagagtccatattatgtggtccaatatttagttaagatttgtattatacacacagcaaaaaatataaaatataataaatatatcctggaaagattagtgaaaactattataaactaagacttctcgatatactttcagtgaatccaattacttcgaaaaaacctttggagttagaaactaaattcctagtagtttaaggataatattttgatttgaattgtaggctgctgtatgt

SEQ ID NO: 789 - DNA, 277 bp, Ctenocephalides felis
nctccctccaacgcaggtgcatcgtcgttggcgtcgtcgctgatctccgtgggggtataataaancgacatcttactctgagattcattcaaatttggaacttctaatgcagccaacttatctattttcgttttaatatacatatctatgcctgcaatatctttgggatcgaacacaacagagtcgctacgaccgcaagaaccgcttttacaattctcgaaatagaaactgggcaaattttctaaaaccttattaagagtctgttgctggtatttgt

SEQ ID NO: 790 - DNA, 500 bp, Ctenocephalides felis
caattttgttgatggcatgataaatataacttcttataattaatattgcagattaaactngtggtatactctttttgccatcagcattttttattgattgaatacaacagattgttaaataatatttccaatcaataattgtgatggtttatttctactagatttgaaaatcatttgattatgatttaaacatataaaaccgttaaatctcgttttaattatttgataatagtgctgaattacacattgtagccattatattaaacaaatattcaaatacttattagtcaaaattagttgttactataatttaatttaaatattgtgcaattttatgtagtataatttagaaatttattattaaacacgtgttttattgtgaataaaatataagagatttatgggaactttttcaataactgaaattgagttgctttgcatttttttaatatgatgaatcgtttttgaaatccatatttatattttattaattgacctgc

SEQ ID NO: 791 - DNA, 326 bp, Ctenocephalides felis
wcmdkccadgnhtastcrysktwbkhtntahdvdacsagdmhacrnvcwrtbwwyrrwykvnwmtmsnwrmanrgarcyrchsncnamnbtydnachcksmcratndatstrandsncncttacaccctccatgctgatgttgaagaatcctttcgtgtgtatttggaacaggttgacgcctncatcaaatttataatttccttcgaaaatcaaattgtcgaacatcaggtcaatttccatttctaaactgtcatcggtcacagttgctctgacttctttgatttcgcaattgctgctcccgaagactttgttgtcttttccctgt

SEQ ID NO: 792 - DNA, 500 bp, Ctenocephalides felis
accgttgttcctagggggataaaataagcaggttataatttttgtaaataacaacaatatttataatcatactggaatttttacagaatttgtggagcaagcctagataaaaattttgccttatttctcaagatgttcatatcttattatttatgttcaatattaaataaaaacattacgaattatgattataaacattaggaaataaattacaatatgactaaattaattttcaatctcctatcatttcagttaatttttactggtgctattatagacttgcttcattaagtttcagaattaccttcaatagttgtaattataaaatatatttataaagtctataaattagtaaaaattgtatccgagtaagcaattttaaacagattatttactcacttaatacattcactaattatatggaatactattagttagattagaagtagtttatgaacaaatgatttgttcatataggagtggcttgtgacaacaaaatg

SEQ ID NO: 793 - DNA, 219 bp, Ctenocephalides felis
aatatgggcaacaataaaatgaacattaacaacgtgaaggcgttaatgtcgcaatactggaagttatacgtttgaaattaccatgtggctcatatttagtatgtttaatacatttagaacccacaaccacgctaactgataattaatatttctaaacggcaatacgtgtatcattccgtgtctgctatcttcgccataatcaaataaaattgtttatgt

SEQ ID NO: 794 - DNA, 252 bp, Ctenocephalides felis
acataagaataagttattattatgaggttaacgacgcgcgaactaaaattatcacgctgaaatttattgcttgaatacatattaaagtaacataaattcaaacttacacatttattcatttatattaaatgaataaatgtataaagattattaccattcacgttcttcacatattgcgtgcttacattattactttgattgtgcaaatattataacatttacattatgttctaatgagtgattttttcatgt

SEQ ID NO: 795 - DNA, 500 bp, Ctenocephalides felis
acttagctgcaagcttttttatattctgaccttgttgcatgagttctctaaagtattcgggacactcatcacgttttaaaaatcttaaaaatccgggcatagcagcaaaatatgttgactgcagctgtgcttgagaccaaggtccagaggcttttgctttatcattttctagaccagctcctataattaatgcggctgtttttgttcgcatagtgtttgttgctactggccagtaatttttcttagaatcccatttcttgatattaaattgtcctttatatactgtatctaaaagttttccgagctcgaaagcttctttttttccaccttctgttaatttactagaactctctgataagttagtcaacttgggtcctccaggataattgcaagcttcatggctggacctcttncatacaaaaacaaactgaagttatcattgctaaaatgtattgactgactagcaaatcaaaagaatcaataactctcatgtactataa

SEQ ID NO: 796 - DNA, 500 bp, Ctenocephalides felis
cgggggccnacncttatccgatanacccatagaccttatactntcatagaccttatncaatacatggacngggagntnancgcataaaaagcgtcaaaagatgtcctacggnatgagggcgtacgagggtaattttgcggccgagatatgtcaaatacgaacacgagctttaccganattagtcgaatgcactcgatcgcttaaattttacagttacttgggttcacgtgatgtttgatcgttcggntttttaaactaaaagatgataaaaatatacctgttgtaaaatnngttaaangtaaaatgtcttctaaaatgtgtaaggnaaggtgcctgattgcagtaaaacctgttttgtgctgttctgtatgcttcgcaagnattccgggaaatncgacattgatcgtttaaaanatcgaggattctttnatatccttcgangaatgtttatttatgttatatatagantgctantcaaagtctttntttatgtacaaagt

SEQ ID NO: 797 - DNA, 324 bp, Ctenocephalides felis
gctgaaggcatgaacgagcaattgagcaatttaacttaagaagttttgacccaagcccaagcaggggccgccgacgtgcgttccagtgtcgacaaattcgccaaagaacacgaagccacccacaccggccactaattataaacagaaaaccttctgtgatcatcatttatcatatcaaatatatatataaattcattaattaattaaaatttgttttatagttgtttaaataatcttcggatatttgtaaaaattatttggatgctcatttgatttatattataaataanatacttcataaaaaannnaaaaatanaaaaaann

SEQ ID NO: 798 - DNA, 500 bp, Ctenocephalides felis
gcctggcctttgtggtcacgggcaggtaaaacccttgacaacttcgattgcatttcaccttacattttcaaatatgtatttggtgtgtcactagtaatttgcataatgtgtttagaatgttccggtgaaactttgctgctatttataaacgttaagcggaattagtgcattacgttcaaggtattatacgagcataattttacataatttaattgattgtcgcaagctacacatttcattaattattctgattctattaactaccgcagattatcctgaaactaaaaaaaatatagatttttaactatcaaatatctctttacctactgctgttcagtattcttttaacagtgtttgaattgataaatgcttttcactattttatttgcgaaaattatggaatattcgcaaacactttatcaaataaaatgataaattttcgtattctcaaaagtaaatgcttgtagnaatctaaaataatctaatcatcgcccaaagtg

SEQ ID NO: 799 - DNA, 500 bp, Ctenocephalides felis
acaataaaaatacgaagatataaataaaaaaatgagaattaacttttttaacaatatggnaagaaatttattataagactaaaatattttgttgtatataaaggtaagacacaactaaaataattgaaaaatatgcaataactcactatacaaataatttgaagaaaaaacaaaaaacacggaaaatataatgcaccaattactatacaattgtcaaagcacgaattttgaaaactattaaattaaaacaaatattaaattaaaataaaataaatgaaaaggttttaaaaaataaactcttttcatcgagacgtgttatatgtttggaaaaaaaattactagtgaattgtgttgtgtgtttctatgtaaagataaggaaactcgaagagctgtttcgttattggtgaaagactgagataggaaagtttttgtggcgctttgccggcgaaaaaatacgaagtaaggantggaaaatatagctttggattaagctgtaatag

SEQ ID NO: 800 - DNA, 500 bp, Ctenocephalides felis
acggaatatacgtttccgtgacccttgagtgccaaatcaacagatggttcaggactgtgggnaaccttanatcttaattcaacacttcctggtgattttttctttgagtcgttaagcgtgaaaactgactcagtattgaaaccaacaacagtcttctcgtccaatccgctagtttgaaggtcaagtggtgcaatcaggttatatgtgataccttggtattcagcgaatttgctggccaaatagaatttgatatcttggaatggtaatttggcggctttaacatttgttccgtgaattccaataattgttttggtagcaccagcgcggaatggatattcaacagcatcatcatatgcagcataagcagaagtcaatccgaattcatacttcacgtcattcacangcttagcaatagttcgataagtcatcaagttttcatgtccagttttcaatggtgtagctgttgttatcattacggnttacggtccagnttaccacng

SEQ ID NO: 801 - DNA, 166 bp, Ctenocephalides felis
acacttttaacgactaatggagcggagtagtgacttatcacaggggccgtataagccaaaggcgctacgtatcctgggcgagcaaaagctacagctacgagagcaaataaaacgaccagtttgaacattttgatttagttttgaataattctcaggaggtctgaat

SEQ ID NO: 802 - DNA, 266 bp, Ctenocephalides felis
acttaataaaatatttaaaatttgaactctacttctcttcttaaaacttttcaaattaaaancatttattttagtaaactatgctcattactattaaatacacatatctaataaaatctgcacatgaaaagaagagcggttaaccgctgggttgctcccttgagaaatatctaggctatatattcaaagaaaaaaaattatagaacacgtagttctgatcgctattgatataaatatataaaataattgtaaaatattaacaatgt

SEQ ID NO: 803 - DNA, 499 bp, Ctenocephalides felis
catataatactaattataaattaaagtgtatggggttgcgttgcttctgggaaaaacatcgcaaggacccatacaccgaatgaaaaaaaataatttattaacgaaacgcgaattactagaacctgccgtggggggtaggcgacaggaacacatttaaacgcggaaatcgttttaaacgatattaaaattacgaacaagtcctcgcacgaacaaaaaaaaaattaaaatgtggacgcaaataactcaaaattataatttaacaacattataaaaaataattaaaaattgtcaatgtgattgaataaaaaaaattcatgcacaataaatccctaaagcaatccgccactgcgcaaaacactgtatgaaatctgaaacaaaacaaatgtagtcaatcgtaaatatttgaaacataagatttatattaaaatttaatattatttaattatatttaaatttaataatctgaagattgattaaattatttatattaactcaaagg

SEQ ID NO: 804 - DNA, 500 bp, Ctenocephalides felis
gaacaagaggtttaggnatgagatctgcaaaatttgggcaagatctaaaatcgaaggaaattattttatatgaatattttgaatgtaaaaaaatgtgttgaaaaatttatattgtaatggatggtttcataaaggcggtgctagaaacaaaattattatagttggttttaacatatattgcaagatatttcaaagatatttgtttagattatttttctacatttatttttcatgctcttatttatagaatcacgattacgataaaatgtctaagtttaaatattgagtctgctgatcttgagtcctaacttcaatatcagaattgttggtggcattgttgtagaagcacttctgtgaaagatcttttgcccatatgaatctgtggtcaatcaatttgcatgtgggttgcttataatttttcctatttggccaattattctttggctacgattttgagacanatcttttcggtatcaaataactcttgattcgaataatca

SEQ ID NO: 805 - DNA, 216 bp, Ctenocephalides felis
actaaagattctttatatttttaatatgttctcattgcacccgtttaatctagttcaagttttataatacacaaacatcttataaatttaagtataaaatctaaaaattatcacacaataaacgctagtctttcagagtaaataatataacccttaagactttgattcttaaattaatggtaatatcaaccacaaaatattggaaaagaaaatcgt

SEQ ID NO: 806 - DNA, 500 bp, Ctenocephalides felis
actgtaaatttttacacaaaatgcaaatatttaatatctcctataatttatggattaattctgccttatgtcggaagtcaaccggatcataaaaagtgatctaattgcgtaaaaaaattagtcacacttctgccaacgtatatcttggagcatcgttttattcacagatatggtgcaatcatttcaattatacgttggtagatcttctagtcttagtcttgtttttataatcatagaggagactggagaaaagaatactggaaaaccttactgggtgatggatatccacaatatcgttagcagatagtatctgggatagatttttggagtttttagtcatctagtaaaatattttttcactaatattaacaacatccagaataagaattgatcaaaaatttttacttcattttataataagtttgttagtaattcgtgataggatatatttttattactttgattattttttaataactttccttccattttaacaacgg

SEQ ID NO: 807 - DNA, 355 bp, Ctenocephalides felis
acaagaatgcaattattgttcttcaaaggaaaatgattgattttctacaccaacagataaaacagtctctaaaagaatttgtaaaacttgaatatttttttcggtgatacttgcaggaaccgtaaaatacaatcaccaccaccacctttagcttcagcattcttggtttttacctttttctgtttttaacacctgtgaactgccttttcctcgacttcaactggctcaacgatatttttagataccaaaaaatatcgtatctggataaatttgttgtgtctgcttttaatattttagactttcattttggtattaacattttttgtgagaacttttacttttactaagtcggggt

SEQ ID NO: 808 - DNA, 424 bp, Ctenocephalides felis
acaagcgatggaccaccngctcncccgcctnngttggtcngtagtaaaagaaatctaaacctnnngttcttatttattaagnncattgngtaattcaacttacacctaggtaatttattaataattatccaattattaataaaaaaaattaatattgactacttaattacatttatatttgctaaaatagtatatttacatcaattttttttttcaaaggcaatataacagaaaaggctcctgataccatgatcaggcagattctttcagcttgtggtccagttgtttcttggaaacgggtttctgcatttggattttgtgaatttaggtgtgtattgtaatgatttattaataagacaaaaatgtctaggttattaaattacgaaattcattccagttgtccagaagctggtttaagagcagt

SEQ ID NO: 809 - DNA, 500 bp, Ctenocephalides felis
acatcacagatttttttttttcaatatatatttcagtggagagaaatttatccaacangggggtaattttgctcataccagtgaaatatgtttattagcccaacttggcttcaaataatataatttttttaaaccttattcacatatttattatcactgtacgactttttcaatgcgcgctcgaacgaaattatgaacgagttttaaaaatatttttagcagctcttacagtgttggtatttgtaaatgatgatatttataaatttcaacagatacttgaagtacacagtcaataaaatttccaatttttcacaacnggttaaatttgcaccaccggnaactggcncccttgcaaaagnntccntntnggaaantaattggccgganncnaanttancttatntttttttcnggtccanaccgccctttnaaaancccttttttttngggaaaaaattttccngggttttttttttnccnaaaaanncnnngggnnaaac

SEQ ID NO: 810 - DNA, 298 bp, Ctenocephalides felis
ggggacatatctaaataacanccaaaacaactctccnttttgtttgtgctgggttgcaagcaagcggggactttagtcaaacgtctntcaaatgcttntaaatctttacacgcagcttgttcaagtgacatgtttactattttttgtgttacatgatcacataagatnatnatgccacagctaaaatcnttttgaaaaaataaacctggtatttattacacactacatcaatttacacttcaaactaacgtngcatttttattgaatatataacatgataagctaaactgaaaaaatg

SEQ ID NO: 811 - DNA, 243 bp, Ctenocephalides felis
actgtatctttttgnctattcacaaaaagtatttgtcagaagtgggattcgaacccnggccctcatagaggaccagaatgctcagccagttgttaaccggcaaggaaaccttgagtatggcgccttagaccgctcggccatcctgacatacagcaaagctttgcaattgtctcatcagaaacatatttgctgngtgtaatttacgctaatacaatgaactttgtttgagatttttttacaagt

SEQ ID NO: 812 - DNA, 500 bp, Ctenocephalides felis
acttcaagtataacccaacgattcacttnnntctgtgcactttggcataaatatccngnaaaatatgtaaaacaggaaccagggcaccgtgataatgtaatcaaacgccggaaaatgatttttgatcgtatccatacctttatagcgaagtcgggaatccttgtgattatattttcctaaaaaaggaaagaagttctcgcatactgaaaagaaaagttttgtctggtggtccgatttcgaactttcaaacttattcattcggttaccgcgaccgcgaatgaaatattatgatttttcttgctcttgtccggaataagatagattgacttcgaatattacggaatataagctgggctgcgagtaaattgtttgatttggggctttttattatcgataaaatatgtgctttctttgaagattgtttgaaacttctgtgttatcttcaagttcacaatgataacattaagcttaataataaatatgttagagcaaacaaaaca

SEQ ID NO: 813 - DNA, 500 bp, Ctenocephalides felis
acttttcaaactatactggagagtttttttcttntattttttattgtaattactatcaatacgatcacctcgttacggtttgacgttgagttctgggacaccctgggtaaattatgttaattatatgtatttgagcataaatacatgtaaagcaaatgtattactgatagacttttgactttaactttacttgaattagtaataaaaccacatgatagaaaattattgagtttttttatagaaaagtttactgttgattttttttattaaatcattgcaatgtgctaattcacattcttcattactcaattttatgcccaactcattataatattttgtttttcttaagttttcatacctcgtatcagaactttctcaaagctcatccctagctttactttaacttccttattatttcactgataataagaacttttgatttttttaaacatatatctatcaagttaaagtttaaaatattcatgaaatgaactttgatg

SEQ ID NO: 814 - DNA, 285 bp, Ctenocephalides felis
tctgantattttatnaatatttaagacatgtgcnaanntgangtnnnttnnatanaanaatngtgcnntatcaaaacgtnactttttttttctctccaaaggcaatttttttaaaaaaaactccgattatccgaatatttgattatccgaatgggtcccggtccccattaattcggataattggagttctactgtataaaactttgtatatttttgaaaattttgaaaaaactattgatatttgtttcagccatacaagttagtttaaaaattaataatctcggt

SEQ ID NO: 815 - DNA, 500 bp, Ctenocephalides felis
actcttcttcgttcaccaatgaagtttgattgtgcatatcaaacttcctgtgtccaccatagccctgaattctttgccatctatggtgacacgtttcatatatttttctcctgtctgatcctttttatcagcaatccaaattatttcaccactaggatttttagtgtcggtttcaattttgatcttattacgttctgggcaatcctgaataaagtgtcctaccttcctgcatcggtagcatatcacttctctttttcgagattgttcactatcttctttaacctcacacttcactttcgtggtagttgcatttcgtgtctggctgcactcatccgtttcaagctttaagtcatttaaggcactttcatgagccaaaatgcttgtgccgagttcgtcataatcggcgtgcttctctgcagctaaaatgacatacagctgttgtctagcagccgtaagtacttgccgttcgttctcgaaactcatgcgtaacgcttggcaca

SEQ ID NO: 816 - DNA, 346 bp, Ctenocephalides felis
actgcatgcgtagtttgcggaatgcttctttccttntagatatgaatacgtcgcattcttgatcccaccacacggagggtttgaataacgttctttttgtgatcttaatttttttttatattcttttctgccgctatttctataattcggattacatgttcgtatttaaaattctccttttctctagatataggcgattgtaacaatcgtgttatgtcttcagcacatccttgccaatttgctttcttgatgttccactttttgtggggataatatttatgtaagttaagaattccacacctatgtttataatgattagaagatggtcagaacccaatgcttctgt

SEQ ID NO: 817 - DNA, 500 bp, Ctenocephalides felis
accattattaaaattattggattgttttatttgtgccactcttaatataaatttgcatgatngtagtatggtgtggatagtatattttatgtagaatttgagggtaactatgtatatatgcatcgataatttttcacgtcgacctccattgcatgtcaagttgcagacgttctgtttatgtcaacattatcaaggtaatcgcactcaactcaacaatatttccatatcccctttttgttatagctaaaaacaatttgtttattgtatttaagcatttaataatgtgttacaacaatagaaattgatttgatgtcttgggcttgccatcactaacagtgctacgagctttggcttggcaagcaagttctatactcatctgggcgaacttgatatcaagcagtagtgatatccgttttcacttgaaaacatgaattataaataaatttgcagttgaaatagcacttctgggaattctgcagaacgtaaaaatataatttcaa

SEQ ID NO: 818 - DNA, 500 bp, Ctenocephalides felis
acaatagccataaagcatgatgaaataatgtncacaatagtctctaagaattccattgttngaaggaaaagttgaaatattattatgtaagttaaacagagttatatgtgaagtattattttctggtgttaacattgtgagcacttcaatattggaattaccccatatacttgttatatattgtgcgcgtagaaaatgctcgtgtaattcggaccgacacggtggtgaatgtgatgcgttatgatttaaatattttttattaaatggcttgttcactttctttggtttataagtgataatgatcttattacatctcgtatcattaacagttctttaatttttcaataatcgggaacatttcactgctgctccctgttatataagcactaagtttttgaatacttcttggtattctaaatttgtttaacaattgtaaaaggtcgttcttaccttttaggaaaaatgatgggtatagcacaaccattagagtatgaaatttg

SEQ ID NO: 819 - DNA, 431 bp, Ctenocephalides felis
accgataatctctcaagaaatgctaatcttttaagtgaaattctcaaccctttagttagccaaggngttgaagtattattttttgggcaaacggtttttttaatgagaggaaaagtttgattgaagttgaataaaaatgtagaaataaagttgtcgaacattgtatttgagtctttggacttgttaagcaaggtccatgattccttttcaagaagacatttgaaaatcaatttatttgattcatcaaaataacgtttgtgtaagataaaagtagatttagaagttgaaaaattacaaaaatttaatattatgcctcgatggtctgaaagagtggtatttataacacgcgaatcaaagtcttttaaattggtgaagaaattatcaatgcaagaagaagattgatgcgaaaaacgagtaggttcatgtatagt

SEQ ID NO: 820 - DNA, 500 bp, Ctenocephalides felis
actgaaaataacaaattttgaattattatagttttacaggtttattttatctaataaaaaangntagttgacattttcgaaatatgtgaaatatatttcaacttacggaaaattgcaaataaatctgtcatgggcatgacagtatatgtatatttagcagtatatgtaattgatttgtccacttttatccattgggtaacatcatatttaccaatatctctgctattctcacatctgtcaatagctgctccacatctagcagttctgcctctgtccgaacaggaaatttattataaactgccagtgtataatgaggcaaatcatccttcatatcacactggcatcactgcttattaagcctattcattaaaacttggtgccgtaatgaatcagcctttttattaatattgagtgcaaaatctgaacaatatacaaccttatactgaggtttaccacaatattctatcaaaggtccttcgaaatgcatagacatctcacaa

SEQ ID NO: 821 - DNA, 500 bp, Ctenocephalides felis
acaaatagaaaaaatacttatttttttataacttatataccatatgaaaaataataaaaactttatttgtttacgtcactatgctctatcattatttacgaaaaatttttatatgcttaaagctttttgttaataattttcaataaaagattcaactaaataattatataatataaataaaggatttaaagtttatttgatattatataagttattagaatgaaatctcactacataagataaaattcaattttatctatgtctcatcgaaatagttgtataattttgaattttgtgacgttttttattttatttaaatttagttatatttgaattgntagtatcatattccattaaccatatttcataggtatcaatacaacttttatattcatattatatatttaaaaaaaatgtttatgaaatttttaaataaatgcaatagcagaatgtattttcattagttataccgaatataggaaagccaggagcttgtgnaa

SEQ ID NO: 822 - DNA, 500 bp, Ctenocephalides felis
acattaaaaatatttgttagagttaaatttgaacttgatgacagtgcaaaaaaataaatataaannatttaaaatttgtatgaattcaagttaaaatatgtatgaatcttaataattaaattttgtgagtaattatatatatatagataaatagatttttaattaatagataacaagtttttagaactacaacaattgtaggagaaggtgaacatcttaaggaccaagagcgaaatctttgaatatcagaaagaaatgtttcaaaatgatacgaaaaatgttttaaagttataagaagaaattaatcacttgaatttatttgaataaaatcttatttaaactccatttattaatactcatttccaattgaacttctcacgaaatttaaaaaaattgaatttattttattttaagttagttaagagttcatattactaaaagttaaatttcattatgtatcctttaatatgttcaccgccctccccataattttattaaat

SEQ ID NO: 823 - DNA, 240 bp, Ctenocephalides felis
actccatgtgtcataattctattattcaatatgtgcaaattacgttctaatataaatcgtgacaatatcataatatatttatcgtggaaataatatagcaattgcaagctaactaatgtctcctagcgtaggagtatttgtaaccgcgcggtatagcgtttccacttgggccatcatcggctgccaaatcccctccaagacctgctccggccctgccccatggagatcgtgcttcggcgt

SEQ ID NO: 824 - DNA, 500 bp, Ctenocephalides felis
acctaaatttcaaaattgatttatataattctatatcctgcgtgtcaaattaaatctatatttaatacctaatatttaaaactaactacgaatgaattcagtgtttcatacatacataacatctctggtttctagtatactattgttagtataatcagaaccactataaaaaaagtcactataaaagttgaaaacctaatttctaatgactattatactagagcacatgataagaatgcagaagcaatataaatctatctttttgtaataaatttctatactattactattacttttcttagtggctcgtaatatgcaaacaatcactgccaccgcagtaacttcagccgtaatttatggcacatcactgccgatatgataattttctatgcttttattactctgaaaagcgtttcgttttggccacggtgtcggttggaaaattttcatcggtggaaacttgccgtagacgtcctcctgctgctccccccttccacacg

SEQ ID NO: 825 - DNA, 370 bp, Ctenocephalides felis
acttgaaaattactacccttgtagagagctagcaaagagtttggtgggactaattgtttacttccaaaactccgcataagaacatttgcaataaatgatcaataaatatatcttcttcaattagatcttagtgataaattaatagtgtaattagaacagcaccaaatacataaattatgccaataaatcagtgtttcacacagcactgctacaaaggttaaactaacctagcgtcttgagttaatcggaggagagactcaacacttaatcttgcaataatcttgatatgatattgtgatctaagcaataattttatcttaagataagaactttttcaccatattatggttagcttaactgtattgtcagt

SEQ ID NO: 826 - DNA, 166 bp, Ctenocephalides felis
acaaaaaagttaaaattttaagaattagcagttgtttaagtgtggcatcaaaaagttgtcacgtgaccacgcccacgattgcaaaagaaagggtgaagaagagggttatatcatggccgaacagcgataactcagaaaataattaaatctttaaaaatcctcgcgt

SEQ ID NO: 827 - DNA, 304 bp, Ctenocephalides felis
accggtagaaaaattgttgataatgtgcgcattactnattcgattttcaatatttgcgatgaccantaagtttggtaggttttcaaggaactctcgtcgtgaaaatactaacattcatgttacaacacatagcaaataatatataaaatgaagtttgaatagcaaatactagaaaaaagacaaaatactggtttacatgtatcaaaaagcgtatatttcatacaaaatgtatgggtggtctagacagaccactccgaccgtttggagtataaaaaagttaatatctttataattatacttttgt

SEQ ID NO: 828 - DNA, 352 bp, Ctenocephalides felis
acgggaagttccagcaatttgccttcaagcacgatnccatacatcactagttttttttgtttatggggatatattactttcgattattactaaaacaacagntataaaactttactattgctaatagaacgaatntttctgaaaaacgtgatatgggttaaacataggaaattatagtaaattattcatgagagtatatcaataagtcaataaatatttgtcttctgaatctttttacattnggctctggttaaatttgcttactaaatatagaatttttagctttataatttatctatattcattanatccggtccaaaccataataaatcagatttgatacaagatacgt

SEQ ID NO: 829 - DNA, 500 bp, Ctenocephalides felis
acgttgcaaaaattaagcaaatcaagactaccgtatttacgaatatgtccccaattcgctgcatacatacacacatacccgcacactagtgattcgtgctctataaatatcgtgcgtcattgatagaaaacaagtgtatctataagctttgacattatattacacaaatgatttatcgtagatgaaataaaagaaacatctgattctctcattactaccatattttatggatatgggaataatggaaataagtaaaaaaaatcatatattttcttgctaaagagtagtcatttcaaactcaattattagggttaaaaattaaaaagaacatataccgtaattaggtcacaatattctgtggtcatcgccaaacttagtaacaccaaaaacaccactaaatttaagcataattgagaataaaagactaaaataattcaggtctacttttcctaatgcgtgacactcacggaanacgttcaatgcctcaatgtgtgacttaa

SEQ ID NO: 830 - DNA, 500 bp, Ctenocephalides felis
ccttaaatctgtatcttaaaaacatttaagtaatgcatttttaatattttgacataaattattaaagaatcaatagttttaatatataatatttgacctagccaaaaaccagatattgtttatctgaatccaggtattgtagttggctttttcttgtgatgtagtttattacaagtcgtttaaaaattgtattggttagctattttcaacaatcttatttgaaaatctgctttgttagcgaattacagagttaaaactattatattttcacttgaaggcatattttagatgaaaaaaattttaggtgaaagccaatatcagtaggggagacaatagatcacttttcttcttataattaatgagtcatcatcacgagtagttttgttataaatttttttttgaaatcagtcaaaaatgttaactactaatcatcagtttactaatcagcaaaatattcggtaatttaaattatatactgagactagtcgaatcatcattat

SEQ ID NO: 831 - DNA, 550 bp, Ctenocephalides felis; identical to SEQ ID NO: 101

SEQ ID NO: 832 - DNA, 550 bp, Ctenocephalides felis
gngtgctnttggtgactgtgactgtactcgtactgtcaacatacttgaagtatgcagtttcatgcaaacttctacattgtcattctcgaacccaaatgacttacctattgttttctttaagtaaaacaatgattgtgctaaattagcaaaagcgttcaaattttattattataattaggaactgttgtttttagtgactgttattatccaattctaatcaaaaatgacagacacacctgataatgcccgaattactaccatggttgaagatgtttttgcaataacattaaacccagaaaaatttgtggactgtgaacaaaaaccagattatattcaaatgatttatctagaagaactagcagaaagtttgaagccgcaaaaacacattgacattgagactttagaacaagctctttttgaaaggttgatgctaacaaatatcacagaatttgtntaccaaaatccagtaagcccccatatatagattatgtagttcagaataaagcaatttctattaaatctgttatgaaagacttagaagtacatgctc

SEQ ID NO: 833 - DNA, 550 bp, Ctenocephalides felis
gnngctnttgaaacagatccgaacaatcgatcgatcggagcagatttttttttgataatagtaataaatgtgtattgttgtggctgaagtggattaaaataaaattaataggttgataataataataagttttaaatttgaaggttatccattacaatgtgtaaaatttttttgctaaacaaataattctagaccaaaatctaagtgcctatcatataggcacggactatagaccaaaaaatacaaaatgtttccaaaacattatgattgttcttaaaaacaaattgtggacttttagttgaaaatgaaatgtgatttaaaaattgtcgtccaaaaatattggtagtagtgaatgttgattgccaaaaacagtagctggaaaatagtgacaaaaacaaaggttttggtagtgtttttatttgcaaaatattggcgtccagattgtgatgataaaattgatagttgagttgacatagttgtgtacaattaataaaacaaagtngtntaacttcaagacttgctgctcttcacaaatctgattgaatataat

SEQ ID NO: 834 - DNA, 550 bp, Ctenocephalides felis
atcgtacgcgcgatacggcgacgtccgacaatattacgcatattcaactaatttattcatatcataaccaaccgttcagttcaaactaaactaaactaaaataaactaaaccaaagcgaaagctaacgactaacggggaggataagcggggggccacgaggcgaccccagtttcattttacatgtgtgcacgtatgcgaaataacagttcgtcgacaagacgttgtacgtccgccctatagtgaaacacgaaaaacctcatatccgatgggataaaatcgaccgaattcagcggacgactgaagatcgccgcattcaacgtcctaaagttaacaacttagcatcagttgcggcgcggtgagagtgcccgcgataggacagcgaagcgatgatcgatcccagttcgtctgaagaagagagcgaggaagagcatggaggaggcggcggaggcgtcaagcagcagcaccaccatcacagccggcagcgcgccgagcggagtgcttcgtcacagcgaaggcaaccatacgctcaccggcggcagtccggcacta

SEQ ID NO: 835 - DNA, 550 bp, Ctenocephalides felis
gacagtttggttgtgtcagtcaacacttcaaaagtcagccaatgaaatttgttttatatttgattggcgttcattcgaattttctttgccgaaaagattagtttataaattaaacctatttgtaattgcttaatgcttcattgattgttctgttcatcttaaggttattttaaacatctaacaatctggtttttggtaataaaaatgcctagattgtctagattaacttgtgctgtggaggattgcgagtttagtacatatgatagaacaataaatgaattacgcagagttcagttttttgcattaccatctggattctctaacagagatcgtaggtcgaagtggattaaatggctcagtgatatcaatggtgaaaattgggaggtatgtaagtattcacatgtgtgctctctacactttattggtgggaaaccttcaaacatgcttttacatcctgatatgctccatcaataaagactcgagatgattatacccattagaagaaaagatgcctggcaagtttgaattataaaagcaaaaatgcaatnta

SEQ ID NO: 836 - DNA, 550 bp, Ctenocephalides felis
tgcacgccatcaacgaccaccacgaaggggtgtcatgcgtcggcacggatggctcaacggcaaactctcgcttgctgtcgagcactgtaagatcgacaccggtcgttctcctcagcacggacggcggacgagctcgtcaatgtaatgacgtagcagcggacgctgcagtccagatacaaacagcgacggaggatgccagtcatcccggccaaaaggacgaatggttcgtctaacaagtaggatcaaacattggtcgcagggcgatgctcatgaattggaaatctcgctacctatgacaattccatgaatgaaaatcagttgcacattttattcataaataaatatagataaacaataaataaaacgatttaaattagtatacactgtttgtgttttactttgatatgatattgcattatataatatatttagcaacccaatttgataggtgtattttgttgaatattttttcagatggtgaaagatattagataaataaaataaaactaaattattttctcaataaattattacttcacacaaatatttc

SEQ ID NO: 837 - DNA, 550 bp, Ctenocephalides felis; identical to SEQ ID NO: 93

SEQ ID NO: 838 - DNA, 550 bp, Ctenocephalides felis
atgacagccatataagctatcataattaaaagtgcttttaccgtttagtattcttttagaatattaactaaacaatcatcatgaaattctacggtttaatgtttgtgttgtgttttgcaactctttccacatgtctaccagtggacaaatccgtagaagttgaggttttcagcagtgaaagcgaaattctgaagaagtacccgcaagccaagcccgctgacaagacccacattgatgatggtaaagctacttatgaatttggggagagagtacaaggcgacaaattgatggtcggcgcaactgatgtatacaacgccccaacccgcaagatgttgccctgaaattcaactttcccggaaaagtaccctattccgtcacctacgcctctgtcgaagtcctacaagattctgaggtcggacaggctttcatcgtctcggaggaatcggccaatctgaaatccatttggctgttgtagctgcaaaattaagcaagtcaatatcctacgaaatctacgccatgtctcgttaaatcttaatgactgaatcgtcgc

SEQ ID NO: 839 - DNA, 549 bp, Ctenocephalides felis
aaattgacgagtcaagaagaactactgccattaaactataagaaatgtgaaaattgttgaaaagcagtgacttttataaaatatcaacaacaattctgtgtgccatatgtgccaatataaacttatttttgtatgtttgtatttaatatttatttaaaaatttagcgacacgaaaaaataagaagcaatattattgatctaataaacaggctgcttaaaaatacctctaactacattagtgattaaattataaattagcaattgcgaaagctttttataatactaacaaagatattaatgtggcagctgaagtaaatgatacatctggtagctaatatactgtgatgattatattttgcttattacaaatgttattaaattgtatattattattaatgagtaccaatttgtaaataggaaatatctttattcagcaattgtgtggaaagcatagtcaattataaatatctataaaattattgtattgtaaatctaatgactaattataataatgtatgaatatgaagcaatctataaatttgngcctcg

SEQ ID NO: 840 - DNA, 549 bp, Ctenocephalides felis
aatcggcacgaggtttaaaggtagtttattaaatgtgagtggtgtttaaatttattaaaaataacgatcaaatctaagttttacaactatggctgctgatgcaagaacttattcgatatgtttgggtgtaacttgtatgtttgcttcgattttgtcggcgtacgcacttcttgtggaactttcggctgaacttcatcctgatcaaccagccatgtgcgatattggtgaacatatgagttgcagtagagtgttgacatccaggtatggcaaaggctttggaattgttggtctaatattaggagaaaattcaaaattcaaccaacccaacggatttactggcattatcttctactccttcatttctactttagctctcatagagaaacgttggacagcaaaaattcaattagctttaagtttcatatcgattcttctctcaatttatttggcatgtattctatattttgtcttcacgatttgnggtagtttgcgtaccatttacttttaaattaattaattcatacttcctataaaagacacagttgtagc

SEQ ID NO: 841 - DNA, 549 bp, Ctenocephalides felis
ngtncngcaccagatttggatntncnnctgtgagaaccatggangggcaattgatcangtcaacttggtgggttantatanggantacngcatctaccatnttcgccngtttaanaagaacntggcttgagtgantantnaataacagnctaacctgcccctacgangatgannaangccntttcaanttcantgggcggaaggtancagacatatncncttttaannngaaagctgganntgaatgatnngcatgaaatatgtaactggcttacgtgacctgttntactancntaattgttatgcaaaaagcgtctttnttatnaacngncaacaagacctttccnttatnnatntcactatagancaattttnngacnangacnatgttgatttttctnnncanatcctanannnncnttngganacattntgtagnntttnnnnnatgangncanaattcnngagtcgatgttctccantatgtttcaacgatttntcctntacntatncnnngnaacatttncaggnacaacctcagnnangnnc

SEQ ID NO: 842 - DNA, 549 bp, Ctenocephalides felis
aaaaggatagcacagattgtgcaccagagaaggacagaagatcaggacaacttggtggtaaagcagagttaggaaaagatttaccatgatggttaatggttgatgaaagtggtttgagttgttctgagaacaaggataaaggataacagggttggagcaattttttttgcgaggacaatgatggttattcaagtcatatgctacatcattgttattcttttttttgtcttcagccagaaaaatgtaaacaaatcacgtgaccaatttactaccaaataatttttacaatttctgccttcgatttaaacttttagccaggacacaaacctttagccaggacactaaagagcaatttttttgcgaggacaatgatgattattcaattcacatcctacatcatcattgttattcatttttttgctttagcaaaaaatgtaaacaaatccgtgcgattttactaccaatttatttttacaatttctgcctctactgcgagattaacttttagcaggcacaacctttaccagtcacaaccggttgaattttgaa

SEQ ID NO: 843 - DNA, 549 bp, Ctenocephalides felis; identical to SEQ ID NO: 116

SEQ ID NO: 844 - DNA, 548 bp, Ctenocephalides felis
aagcacgtgatataaaaatgaatatttgaagttatgtgttatactcatacctcaatttgtatcgtgcttacgtccaagtgaattattgactgatatgtctatagtggcttctatcatatttagagtattttgaagctttggcggtatgaagtaagtagcagtatgcggcattctggtctaaagcaactttttacctcaaaacaacattttacttcgactctgactttgcagaactgaatggtgagtcaatgagcgcaccacgcttaactagttaaggaacgatgcaacttcgaataaacgcaaaacgatgcaaagtgaggtatgggtgtctacatttgatgcgatataatataatattttgtacgtattcagaccgcacgtgaagagctaaccgccaggctctgcgtctggtgacgtccagcaaattgtagtgatatcaatgtccgattcatcattaactggctaccagacatctcgcagcagtctgacggattaccagcatcactgactcacccaatccttgcgtcacaccactctcattcaaccgt

SEQ ID NO: 845 - DNA, 549 bp, Ctenocephalides felis
acgaactgaaatcaactattaataaaatatacctgtatcttttacctgtgacggttctatttgtgttgtattttgacaaatacagtttctgtttgcgatcgaattatatatattataacgagaattgtgtcataagtagaagaagttagcggccaagatgtggcgattgttgggagccgttcttgttctttctgttgtcaacagtcaagcccaattcgaggaccagttcttgagttggaggcgagatgtaggtgccaatcgtggaagcgtttggcctggaggctaccaaaatgtttaccctcataaccagaggcatgttcctaaaaaaacacacaaggaagaagaggctgtcactgaaagggaccgtgaaccacttgagcctcattcaaattgggcaggtcgcagaacagccgatacatccgacatcgaacaaatcgagactgttcctgaattgctgaaaccagtgacgaagatagtcgtctgatgtcgattcctggtgccttctctccttggaggactcggaggatttctgtgacaatggcatactct

SEQ ID NO: 846 - DNA, 481 bp, Ctenocephalides felis
ataaagcttaattattttttgggaaaataagtctctacggccacagtagttttatttgttgctgtgagcagtttatctttatactattgagtgtttagaaaaatcacaactaagtcataaaagccatagattctactttgatagtgttgatgtagcttgataattttcattaatcaaaatcagattaaattttgcgaacgcggtgtgttagtaaattgacttcatattgatatggaatccaaagaatataaaaattaaacatagaaaagcaaaatttgggtagtctttaaattatctgaaacaatagttagtgttttgttgtttaatagaaatgttagataaaatgaaatacgaaattagtattataaaattgatgaaaatatttatgttgatatatttgggaactataaatgtgctaaaggtgtaaactattgtatgtacatgtgcaagatgttaaataaatagtatcattgtnaaaaaa

SEQ ID NO: 847 - DNA, 548 bp, Ctenocephalides felis
gaagatgtcgtggaagacaaagctacattgcgcgaagctgtactgaaaacttgggcacaactagttggcggttgtctgatatttcgttatgtacaattattttggtatttggagctttctccaacgcatacaggaagagcatttgaaaactgcacggctgatttacaggtatctcctatgctaggaacggcaatagaaggaattgccacgtgcctatgccggctgacgtcgaaagtgatctctcatcacgaacccagatttgccgcggccttagattcctttgtaggaacggcacttgttgtggctgcttttaattactcgggtggatatttcaatccagttctagccacatctttaaaattcggctgcatgggacattccgcttgggaacacgtgattgtgtactggttcggtgcttgcgccggacacttgcagcagttgcgttgtggaggattcccaaattagaaatagactaatcggtcgaaactaaaatcagcgtaatcaaagcattagtcatatcgatcaaacaaatatacaaaaataagaaa

SEQ ID NO: 848 - DNA, 549 bp, Ctenocephalides felis
gaaactacaaaatagtgctcaacacaatgaactccttcgttacaactgttgccatcgtcctccttgcaggaacttgcgcccaaggtgcaacaactgtgctctcctctaccaatggcaattaccacggcaactatggatacccatctgtcttatcccaaggtttcaacaatttcaactcattcccaactacttacgatcactacaacactggagtagtcgatactgttgtttcttctcccgtcgttaaatcttcagtcacaacaactcctgttgttgataccgttgtttctactccagtcgtcaaatccactccagttgttgcaactccagttgttgaaactgttgccacaccagttgttgcaaccaccggttataccaccccagttgtcgcaaccaccggttacaccactactggctacaccactccagctgtatcgactggatacaccaccactggatataccactccagcagttgcttccactggatatactggttgggaagtatcgtntggtttgggaggatacgatttacacatctattcaagga

SEQ ID NO: 849 - DNA, 549 bp, Ctenocephalides felis
ggtaaatctagtaattattcgaagaatttagcaaaataataatttttgacaaaatggcggcttcttaaaaaaatcgttttttggcgaaattttaaccttaaattgtttataaaaataaaagtatttatcggatcgcgaaaatctttgattaaccactaaaaaatatattctatgcaaatcctattattataaattattataagactgttcaaaatgtttataatatgaaaatataagagactctccaccgattcggaaacttctaataactccaaccggtgttgtctgcatcccttcttctatctcaacttctttttcggcatatgaattaagaaaacactgttataaaatttagaaagcaatactaaacagtcgaatcacatgcaactaaaatttcctgttgtttattaagttttttcgcggatacttcttccatctcagccgtnttttcttttcaaattgcgaacttgaaatattcccagaatgagggaaatttctgtgtgcattttaaatatatgacatcagaaatcttttttggaaactactgtt

SEQ ID NO: 850 - DNA, 549 bp, Ctenocephalides felis
cncgcttatcgcatctctaacaaattcgcaaataataatcaatttagtaattaaaaaaaaacaattgcactaaaatcaattcaataaacatttacgaaacgcgaattcttttaatccttagtgtgtgtgtctgtgtacaataattcttgttaacaattacttattattgtgaacaataaaataataagagttaatataaacattttgttacaaatagtttaaaacaattctaattaaataattcgtctcgtcctatcgggtaacactatcaaggaatgctttgcacaaacttcacgatggtgctggtgctggtggtcgctatggtgacggtgttgccagatggtggtgacggttcgccgtttcttgatcgattgttttcggggtacggattggcacgagcctcttcgaaacaaatcacaggcccacaaacatccggaacagctacgcccggagctcggcaaccggagatcgtcgaacggcccggaggcggcgaacttacaaacagatttgcaatgctataaatccaagcccctacgcagccctggagcg

SEQ ID NO: 851 - DNA, 549 bp, Ctenocephalides felis
gaacaggagatnttggaagcancactnatcatatggacatgtgggtccaggagaagtctgcngngtgattttaaaagtgggctccanagaatttgtangagctggcnacacgccccangctgcccggcacgatgctgcttctaaagctcttgaggaattgaagaatcttcccatgccagatggaacatgtcctgctgtgcaaggcgatcatgtaactgntccaatggaggatgatccanattctgaattaaaatcacctatatctcttgttcatgagatcgctttgaagagaagtntagctgnacacttcgcagtatccagtgaanagggtccaccacatatgaaagtttttgtcacaatttgtaaagtaggtgatnngcaaactganggagaaggcccggacnaaaggtatcaaagancgtgctgcagaataaatgcttgaggaactcacaaactngtccgattatactaaacagacctgtggagcccctntgtgcgtactagaatnaaacgcnacctctgtccaagannagnaagaaatctgtaaag

SEQ ID NO: 852 - DNA, 549 bp, Ctenocephalides felis
aatacatttgatactcaacccataacttccataaaatttatacatttttctatatcgacctaaaacagttgagtagacgtggaaaaaacatcttttagtacttatgagtagatattgttggtaacaactaaaatctaaccaatgccattatcaattgaatttatacgaatgactttggattttgaaaacagtgaataaaaatttatagttataaaatcaacacctttaaaattttgatatttgtcaataaaataggcgataaggtatttttatctgtcttatgagtatctatatcaaaaaatattccaaaaaccacttttggaattttgatatttgtcaataaaattattattaagtttactatttactggcatttttattaagttattattttatgcagacatgtaaattaaaacgattttagcaaaatattgttgtgcattacatatcataagattaatattgttaaaaatgagttttactgagaataaataactttgaagcataatgtttattatctcaaacattatctgggtaattatatttctc

SEQ ID NO: 853 - DNA, 548 bp, Ctenocephalides felis
ctggataccatcattttagttatgtattcataaaaaatcatatttattgacgaactgtattgttgatagtaacgttagctagcacgatatcaagcaaaattgaggtaatgaagcagattttcctttggtttttcatattgtaggattgagttcacccaaatctatatcaaattatttattagtatttttcgtagtctttgaaagacgaatttggaatagatttatatttaaatgaagtgaagagaagttttttgattgccttgattgttgaaatcaaaagctttctccaactagtgagtcctatattaaatctgtttaattgtccaatatttatattttgaactgtcatacaaccttcatatttttctacttcacttgaaatttatggaaaatatgattttaaatgaaaattactttttaggatgccgcgattaaaaatcgattgaaatctactctctcaattttttattatgtatatatttacttcttgacggagttctatattcaattcctatgaatcaaaaagtttatatcaagctttttataga

SEQ ID NO: 854 - DNA, 549 bp, Ctenocephalides felis; identical to SEQ ID NO: 121

SEQ ID NO: 855 - DNA, 549 bp, Ctenocephalides felis; identical to SEQ ID NO: 80

SEQ ID NO: 856 - DNA, 549 bp, Ctenocephalides felis
acaaccagaaatattgctttcgattaaaattaaatatataataaaaaaagaaattgattttcttgtattttaattactaaaaatgaattttagcatggattttaaaagaaatgaattacaaatttgtaatggatgtatttaagcagctaattcgttgaactaaaaatgaaaaaccaatttttgtcttcttcatttatatatgtcttgactcttgatatttgtcatcattctcaatctaaattataatttgttttgcacaatgaatacaattataaacatattataacatttagttgaaactacttactactacaaacataactattattttaaaataaaatatgaatattttaaaatagtaattgttgctctgtttttcgttaattaaatttttcacattgaaaaaatatttgccatttatatttaaattatgattttttaaaagtaatgtgtaattttattgtattatttgaatataaatttattgaatgatgcacatatcagngtcaaancgcgtaagagatcaaaattatctgcatttaaatctga

SEQ ID NO: 857 - DNA, 549 bp, Ctenocephalides felis
attagcagaaagctgcaagatgttcataactaacatggaaataaaatatcgtatagagagtattgtcatggatatgtatatatgtcttacacaatgtatagataatttaacatgcaaagactcacagacacctattcaactgtgtcacgcgttcaaaaatggaatgaaagaaattgcaatagcttgtgctcattttctagaactctgtttagatttaaaaatcaactgcaacaatttgcatacattggacagacatgcaatattacgatatgcttttaatttatttcctacatttgtcaaattattatacaagggcttaaaatgtgcatgggactcgttcaaaacattatcaccttctcataaacaagagctcgctcagtatgttattcctgaggtcagttaaaatatagttgaagcagagtcaacatctgaaggccaagccggtcgaaagttatttctcgaaataaatgtgattatggatataatgagttgctatattgaaatactcacagcaaaattcttattaatgctctatggaatgataaangg

SEQ ID NO: 858 - DNA, 549 bp, Ctenocephalides felis
gttgcgtgtaaattgagtatgtcatagaccttattataatatacattattttgtaatttacatattattaaaatattcatatgtattacataagatcttttgtggtgagtgcgtatgttgtatgtatgaatatcaagagcttggttcaaccgatttgaatgattctaaaatagaaaatgtagaaatatgtagatagtggtgtgtgggtatctatgtacgtatgtgcggatacaatgttttgtcgactttttcaagagcttggctcaaccgatttgaatcattctagaaacattttacttgatagaaagatgtaaatagtggtgtgtgtatatttatgtatgtatgtgcggatacaatcttttgtcgacgatttcaagagcttggctcaaccgatttggatcattctaaaaacattttacttgatagaaagatgtaaatagtgatgtggtatatctatgtatgtatgccggattaatcttttgtcgcggttcaagagcttggcgcaccgtttggatgatctaaaacatttacttgtagaaagatgtcata

SEQ ID NO: 859 - DNA, 549 bp, Ctenocephalides felis
gagaccactttcattgtattcttcagactattcttcagacctacctctcacctactctacggttcactcagtgcctctctatggagcccccctggtacacagaagtgtcatcgttcaacgacctgtgtcggtgtacacaccatccccgatgtccgtggttattcgcaccaggccatcagtcctggaccgtgaattcgaccgcatccaaaggcgcgtcaggcccaccacctacaaaccagtagaagatttcttaaacagcagcagcacattggactttgacgatgaaacaagaaaaatccgatctcaagcaaactcacttttgactagaatacacactcccgtacatagaccattgaaaacgatattcttcagtactgctggaggatacggatcaataactccttcttaccctcatttggaggaggaattatcccacatcttccaacctctgagcaactaccgcaaaaatatcggcctggtcatttggcatgcgtacgatccgcagcgacaagcctcaacaagangaatctactaccagaagnggaaaat

SEQ ID NO: 860 - DNA, 549 bp, Ctenocephalides felis
aatctacgtactttcactaaattggaaaacatgaaagtaaaatattaagcgagttttgtaaaaatctagaattaaaatttttctaatgtaatttagtaataagtataaacatgaagagaaactaaaaaatgccccttaattttaggaattataaaatgtaattaatgtgattgaataatttttatataaaaaagctaactaaataactgtagtagatattattagaactttaagatgtcaatcactcgaaattatgatgcaaatgtatgtaacaataagaatgatatccgacgttttgttttctaaaaatttgcatcatgatttcaacatttgacgtaagtgataaaaaattcctaattattcaattactgctaattagaaaagagaattctcaaacattgctttttccgataggcaaaacatttttcttttgcaaagcttagatgattttttaatggacagatgttaatcatttctagtcgtaaacgataaacgaaatatttcaaataatttgtattcnttaagaaaagtcaatataatgnaattcaa

SEQ ID NO: 861 - DNA, 549 bp, Ctenocephalides felis
atagaagcaaaagacatcaagatgaaattggcgattgtatttttggttttggcagtagttgccttggctttagctggtgaagcaaagcaaaatcagcgtaaacatgggcagaggtcacttcaaaatgctggacacaaaggagctgcaaggaagcaaaataatcatagtgcatcagccaaatttttgtccaggaatcgacgagccaatcgaaatgaagaggcaacagcaaatgaggctgttcatgatatagatcgtgaaccagaacatgaaggaggtgctgaacctgtagaagatcccgatcatgaagtagtcattgatggtgatgtagaagatcatgaatctggtgtcgacggatattctacaaataatgattatagtacttacaacgcagaaagtacgaatgatgctattgaagcagcaaaaaaagctctgaacaaagccattgcctcttcaaacaagctcgtaaagctttggaccagttggcgaagaaccttgacttagacgtgcagttttgaccatgtaagttctggaaaatcaaaagatcaacaa

SEQ ID NO: 862 - DNA, 549 bp, Ctenocephalides felis
atactatttatcattagatcatatggttataatagaaaatttaattttttatactaattcttgtttttcacaataatttgaagaattctcttcctttaagtatgtatttaactttatatacaactttgatgatataagaaaatcatgctctttttatttaaatcttgtagtataacgcgttttttttattaccttaattatatttaagagttttacatttattagatgttttttggaactaggacttgccaaaataaaaatcttattctgcattttccaagatttcagaataaatttttctgaaagctgataaatgttcaataatcaatataccaagcagtccttttcccaaataatttagtaaatatatatttgttgtaaataataattgtgttaaactataatctttttttctattgaggttgtgcaatgtcaaggacatccaattccagcaaattcgtaaagattctggcgcatttgatttgtattttatntattgtattatattctattgaattaataataaatgtttatggtatcgatngggcg

SEQ ID NO: 863 - DNA, 87 bp, Ctenocephalides felis
cacctcggtggtgaaagggcagagcaccacgctgaccgtggccttccagccggagggcgtaaccgacaagagagagagagaactagt

SEQ ID NO: 864 - DNA, 549 bp, Ctenocephalides felis
cattactccagtgccaattttaaaacaaataaatagacacaacgaagatggaagttattcatacggatacgaagccgccgatggttccttcaaaatagaatccaaatatcccacaggagaagtatatggaaaatacggttatattgatgaccaaggacaactgcgagaggtggagtatggagcgaccagtggacgaggtttcgaaccggcaggaaccggtataaaagtcccaccaccaactgtcaacactaaaaacgaatactacccacccttgaaaccaggcgaagaagatgacggccaatacagagaagaccccagcatttattacaaagattctcgttacaacagcgatgtgagcaacagtttgcaacaacaacaaccccaacctcaatacattcaacctcaacctaaaccaagtgctgcaccatcgtacgctgtcctcaaagaaagaacttctactttatcaacaatgcctccctgctccagtttcggaagaccaaaagaagattctaccagctaagtctcagctaacagcaatattaccacctc

SEQ ID NO: 865 - DNA, 549 bp, Ctenocephalides felis
agtgtacgatgtggtgctcaacatgatttgaatacggataactgatcatcttatggatcttatggatatctcatacatgaacatatatcaatgataatggcaactaattcatcggaacctacggttcgacggaatcgttattcacggtcgtctacgaccagtgtgacgcaactgttatctgaaagttgttcgagccttcttcatcggttgacacggcgtggaccatcggaaaagcccacctaccgcgtgcggccaagcaacaggcccgaagaaaaaccgatagatactgtgaaagtttctagtaaaatatcaaccgccgttcctgtgacaattacctctgccttgggaagtaccagaagccggcttgaaagcaaatattcagcagtgttagaccgtgtaaaacgtcgggaagttatagatcatgataagacattagaacccagtccattcgtacccacggcgcaaaaaaagtgcatcgagtgnattttaggtgaaaaggcttatcctatggagtgcattagaaccaaagtnttattggatcgcgatgat

SEQ ID NO: 866 - DNA, 549 bp, Ctenocephalides felis
agttgctatcagttaatagctgtaactcaaacatcacacaacgtaaataaaacaaatccttatcttgtcgtgatatcacaattcatttttcatttttcacatatcttaacagaatataatagtacgttcggatgttccagtttatttgcacgtggaccggtgaccgttatagataagagagataattgacagtgaacagtttttatgaagtgtttaggatattgagtgcacttttcgttttgttttggattttgatggacgttggattatctgtgatttagtcagagaatgatatatgtgcttgaagtcacagaagattattagcacacatgtatttggatactctgcagatagaatagtcttcagtattttgataactaaagagccatatatttcaaatgtaaaatattatctatacattcttttcaagttgtgtcttagttttcttgcagtagtgctctttttatgaagatcttttaatttagccctgtcgtctatcagtttgtggatttgatgccgaacaagggttgctgaagagagtgcagacnt

SEQ ID NO: 867 - DNA, 549 bp, Ctenocephalides felis
gaggagtcggtcctttagcctggggtacagaaacacatcgaaaaccgcagacgcttccaccaaatctgagtccaaaattcttccatagatcgccaagagaagcattgagaagagtcactagtctattgatcaggaaaggggcagctggtggaggcacgccccgtgactcgcgtaaagaacgcgagggcagcgtgttcccgatgccgcttggacaaacggtgcatagggaagctttagaggaagtggtgcctaaacaaagaagaggatttttgaaaaacttttttaagaaatctaaacattactcactggaccagtaaataatcgaaaagttgacaatttaccgagttctatgttttttaggcataagaaaatatgtacactgccctcaactttagtcctaaccataatattagcattgaatactactgtagttacccgtttagttgtaggattatttattattctaataatgaattacaattaaccgtctgatatggacgaangggaagtaagacagttgcaataaatagtgcctgagaaatacatttt

SEQ ID NO: 868 - DNA, 549 bp, Ctenocephalides felis
gtacgaaaggaccacgccctttgttataacatgacattaagactcaggtagcttaaataataattttttaattctataagtatcatattataggccagaaacagcatgttatatatttatatccgaaataataagtagatttatatacgaacagacaagtgtatccaaggaaataaatttaatttatttatattattaatggtaatttatcaaaattcagatatatatatatatatatatatatatatatatatattttaaattaaaacagcatatgtaagtatatatatatgccatatgcccattaaattcagagctatttaattgattgatgagtacttaatcatttttttgtcgaaattgttttagattttttatatttattagtataattggtatattatcaaaatattatacttataccaatctgttttatatttttttcatgaaatattatattttattatgaaattattttaagcgttaaaattatttaaatatttcatacagaggcagcgttattgaaaactgcttttttgtatcttgtac

SEQ ID NO: 869 - DNA, 549 bp, Ctenocephalides felis
cgcggtggcggccgctctagaactagtggatcccccgggctgcagggtgagattaaatcgtggacatcagatcaaccaccggacacttttacagaactagccgtaattgattcaacgaccaataaaggagcaagaaggcaaataaaccaaaaagatggcaacctatccaaagcttgtcaataagcaattcaattcaccaattaaactgtattctccgcagaacgttcaggaaacgctcaacaagcaaactcagttgttagccaatggagcagttggaatcgacttcatgcacaacaagaacgtggataagccaggcaacttagcaaattcagctgtcttgagaatgcttgaagaagaagaagaaagacaacgaaaaggacaaccaccaagtttgaaaagagttgcctggccaccaccagctgaacctgaccatcaatcaggaactccaattttggaacaagagcctgtcttcgctcagacgcaacctccgaattattcgacttcaccgcacagcaacagtatcagccgaacccacgcaagccttccgcc

SEQ ID NO: 870 - DNA, 549 bp, Ctenocephalides felis
gctcggttaacttatatctgaaggctccttgacagttgttagtaattaaatctaatatattatagaataaggtgggttgtgcggttcagcaatggtatcacgctttaccgacatccttatacaataaaaaggggccatctcacaattgcaattatataactagttactaagaatttgaatattatatatcatagttttattatgaaattggataactttatacaaagattataagattactttataaatatacatatatttaggataaagttttttatgaaatgaagggctagttgatttctttggtttgagatatgagccatttgtgatttctggtagtaggctaggccagtttgtctgtatgccaggcagataattataatgaaatgtaacttcaaaggacttccatactctgaagaatcacgagtttaattttttaatattttttgtacgtgtttgcaataacttctttaaaattgacattcaatgtaaaaacagagaatagtcttatataagtatgatttgagtggctccttatttatatgaatt

SEQ ID NO: 871 - DNA, 549 bp, Ctenocephalides felis
gctcatttgactgaacgagaaaagctatatatttataccatccattatacggtggatgcgtagtggagctttacaaagacttaaacaattattagtgaacaaacaatgtgaaattaaagactttgcgatatacgaatatttaatgccttttcttacagaacattttaaacaattgaattttattgaatgaatcactctgattatttgatattgtgagatttggaaaacataaattcactaaatgtatatatgaatgggaccgtcactttgatagattaacgagaagttattaattataccgaaaagaaataattgtgtgttttcttagtaacatttgtttttcgttctcgtgcttcactcgaaataaatcatctagaaattttcatgaagcgaactgtggtgaattgttttcgtgatatttgtgatgaacttctcgtaaggacatatcacgttgtattttctagtgcattttgaatctatttaaagttattatatttatagcaagtaggcacatgacgatagcaatgtttattattatactcttagaaa

SEQ ID NO: 872 - DNA, 549 bp, Ctenocephalides felis
gtgttcgatagatcacataggcaattttgttattagtggaatagtttgatagttttccatatggtttagtgtgtgataaatcaatatttaaatttcaagtgtttgtgtgatatatgtgattagaatacatcgatttgataaagtgatttgggatcgtttgggtgcatctcatatgcattaattaaatataaggattgaaagattttgtatagctttagtagtaaaacagcttagtttggaggcagattatgaattctcatgagaagttttaatgaggtgacgagtaatcatatagcaagtattgacattattacatatctctcaaaaggactaataaggtaatcatctaattgatacctaagtgtgaaataaatttagtatgttgtggtttagaattttaaaggatcctacttgaaaattatgatacaaaggtgaatgttgccagtttgttatatgccgnnttaaatcacgtaatcccactccccactctttaagaacaatacctcaatattcattgttaccgacgataaatagcagcagctantcacc

SEQ ID NO: 873 - DNA, 549 bp, Ctenocephalides felis
gagaaatgtcaaagtggttaatggaattattaaagttaagttcgaagataaatttagtaaaaaggtcagtgttagcattatatcctatcaaacaataaacgaattagtaaatatcgaagcatacttattattatacacttagacttctcaatttttaaagaactcatcatctgtttgtttattataacctacaaacctcaaacatgtctgaagaaacagattttaacaaaacaattaaaacggaaccgatcgatgattatcctcaagtgaaacaggaattcgatgattgtgaaaatacatcagatttgtatatggatgatgatatatgtctgcagcaatttgaaaaatctgaggttacaattgacgaggaaataaaacaagagacgattgatgaccaagatcatgtgactagtacaaacaaactgttcagatgaaaattcttatattgtgatgaagaggcagtaattcaagnaattagtggtagtacgaacaaattattggaaaagttcaggcaaaanggaaccactaataattggaaccgnttctgtn

SEQ ID NO: 874 - DNA, 549 bp, Ctenocephalides felis
agtacgggatgtttcaataatttgtcttaaggcacaatgccatgagtcactagtttaaaattttttcgacgctataagcacaaatattgtgcacttccacacaaattcgtcattttaagagggctcgagaactgaagtaaatatttttcttaaactttcagcttgtttacggaaatttatattagccaaattgccaaatttaataacttagtaaccaatttgataatttacgttcggagagggaggcaaggcaaaataataaattttaataatcggttatttcaacccaaattttgccttgcaatcgtattatgttttgttaattatatttcttgaaatataaaaatgttggtaaaaaaatttgattacattgtatagaatttttttctcactatccaaattttgccgccccaaaaatttgccgcctggcagtagccccgattgccctctgaaatccagcctggatgnggatatgnatatatatatatatatatatatatatatatatatgaaatgcggngcccatatatnatngggttcattacaaaa

SEQ ID NO: 875 - DNA, 549 bp, Ctenocephalides felis
gcgttgcgtcatacgttagaaatgacaaagttttacaaattcataagatttaaatgaaaccgtttctcatttctgtttcttttacaaaccgtgtgctcgatttatgtagtttttgcccaagtactactgtctaagacgcacgccggatatatttcatctcataattttaatttgcatcatttggtgcccactgttatataaaactaaataatattatttctttgactaagcaagagttcacaattgaatggctggccgtcgctgtgttattttatttcgagacttattgtgcaggaaatcaagatgaaatcacatggaggccacaatatatcatatcaagttgttgagtatcgaatggccaaatatcgagtgaaaattgcacaccgctccttcaccgggaattgctctgaaaataatttatgaagtctttcactactgctgtctgacactgctcttcaccaggaatctttccagaacattttaccagcttttnactactgnttnttttcactgncccttcccagaatcgtctgaaatatttaaaaaagt

SEQ ID NO: 876 - DNA, 549 bp, Ctenocephalides felis
gatgaagtgaatacacaacttgataatagcaagaagttatggggtatagagatattgccaaaaacaaaaaataatgtcagaaagaattttgaaaatgccttaggaattgtaacactgacatttttatcttgtatagtattaagaaaggtgtttaagattttgtaagctaatatagccatatatttccataccttgaagggtatttattataatataatttatatcgttagtcaaacttatgtatacagataaatttcacattatctattacattttgttttgttttgtattatagtcacatgtgaaaaatatataatattaaatttgatttcattttgcctgtttattggttttgcaaaaaaatcctgtacctaaaatcataataggtttcgaaatcacatacttagcttagagtaatgaacttattaaagaaagaaaaaagctgngttacttatgggctaatatacgngngcaaatgtaaanccccaaaagntttgctggaacaattggggtgatgnatcatgtataaanatatagttttgaaaancn

SEQ ID NO: 877 - DNA, 549 bp, Ctenocephalides felis
gtccgtctgtcaaagtacatcagttaacctcaaagatatacttcaaaaagacattaaattgttatgaacaattatatgtttaagttaaacatctgatatgtataagcaattttttgaactcgattaaatacaataagctggtacacaattcagtacttcaaaaataagatgaataaatgaactggttaaaaatgagaagtaaattgtgactctttgaatatgtttacgaccgagtgctcaccccgttcagtcgatgtgctcatcttaaaatctgctaattgctataaattaagttaactatagtatgaaagatctaaagagttacaaataagagataatgtctgtcgtgggagaaagaccatcatcaatgatggtgtcatgacatcatctggtattggaaatccaagtgtttaccatgccctatagtgatatttttagaattttttgcttgggggctcctacgatgccaataatatctgtctaaatgaaacattcccagtcatcattttnatgaatggttaattaatggtataaangatttatcttcta

SEQ ID NO: 878 - DNA, 549 bp, Ctenocephalides felis
aaaaaatagagatatttataataatagtaacaatataataaattctaaaaatgttcagtgtaatgttatcagtatgtacaagcatagctcgagcaaatgcaatatcaacgaatttaaataaattaagtaataagagatctttccatgaatcatgtgttacttttgctgctagaaaaaggtaccagagaaaaggcacgaaagaagaaaggagttaaagtcgaagaaaaaaaagttggtttcatcccacataatattcgtgccaaaaataagttagccgtgagcacaatagacaagcatttcaatgatagctacaaacatgtttcaagcgacaatgttttcatctctaagttttacaaaatgaaagtttacgattttgcagaagcaatagctgctcataggcaaacacatcatcctacgtgtacaatgttccagatgcaaatctaaatgttaaaattgactaaacatggctggtggaaaagtacccgattatggataatttcacgantgcatgtacccctgcttcgtccaatgtgaaagactntcntgatc

SEQ ID NO: 879 - DNA, 549 bp, Ctenocephalides felis
atctttaagtcatatttgttgccagtttaactatagttatatataaatatataaccaaaataattgtgatacttcatgcctttcattacaactgatataaaaattaatttgcgtctaatttgaagtcaacattaagttaaatagttattagtctaaaactcatgaaaaagtatagggttcccattatctgcatcaattctataaatggtatggaaaatgaagctttaaaatgattgagtcaaatttgcattgtaaaaaagaaatgtcgtcttacatccatatcttcatatttgacaaaacgatattttttaaagtaaactttaagcttataaaaatcttaaatacatgcatatttatatatatatatgcacaggcaaatcctattttgctatgtcttctctttggtgcttttgggaaatctgntgaaattttatttaataacaatgagagtatgcaattaatttccttgccatttatgttttacatggatgagtttgagactaattaacttcattttttaatagtgatatagtcgcaatatatttggat

SEQ ID NO: 880 - DNA, 549 bp, Ctenocephalides felis
acattatcaatcataatagatagtagtaatgagtatagtaatatgatgttttctcagcattgaatgagttttgtcacaatccaaaatacgcaatatttctaaatcgattaaaaacacgtcacactgttgagaaaataatatattgacttactcatcttttggaacaagttttaactctaattctgtgcagttttctacctcagaactgaactaattttcgagtattaatagatatacgttaaattatcacaatataaacgtattagaaatatgttcatgtttttaattttctttaagaattagttcacaattaattaggaagatcgcctgccataacctaatttatttagctgacaaatttaaagtttcttgcactcccttgaaatttgtatatgtttacaattttgcaaaacggagatntcgtacacaatttgtttagaaataagattntagtatggcgcgtcctaccgagaattcctngggcagtgagggaaaaagngtttnaanggtaaactattttagggtaaaagacgaggtctcnttaancca

SEQ ID NO: 881 - DNA, 549 bp, Ctenocephalides felis
aatcggcacgaggacgatttaaaaagagagcaatttctgacaaagaacgggcagagtctaatcgaaaacgatcaaaaataatagatcctatccctacactgtctactaattctcaatgcgaggaaaatgctgatatatttccagatacttcatataaggtaatttcaatgcctatgctatcccaattgacgcctattgaggctgcagaaatggacgtggacgatccactcccattgttgccattagattccctgttagcctgcacttctgatacacatcctggtccggccgtagaagtgcaagatgctcatcagggtatgcagggattaggaatggcagaagatgaattagctggattattactatcaagtggatgggatgaatcacaactagaattactagattcattactggattcactttaaagaagaattagaaattactcatacttaaaggtaagcaatagtcttgntggtaagcctacaagaaaaagactttatttggtnaattttatctaagatgacgagcccaaaaatttggcattttttg

SEQ ID NO: 882 - DNA, 549 bp, Ctenocephalides felis
gttnaaatggcgcctattctaaaagaagtaaagtctcgtaaaccttacatactcttgtcagctcgtaggaagcgtgaaatagcacatgaagctaaaaaggaatttttacaataccttaatgccaagcatccactgtttactgagaaggatttggatgttaccatttgtggctccagtacaagtgttgaagacgtcgagaagaatttatatcacacaacacgtgtaaacgtcaaacatcaaagaccttttaatagcattaatgaagaacaaagctttgtgctttgtgataatgaagaaaatgtagaagaaccttcttacacacgtgtaaacgttaaacgtcaaagaccttttaatagcattaatgaagaacaaagctttgtgctttgtgataatgaagaaaatgtgggagaaccttcttccctctcacctttgcaatgcgaactacagaatctgttaatacccaaactatgacgccagagtgtcaactaaattgtggaaattctgaggcgcatggcataagaatgaactccagtagatctacacatatgc

SEQ ID NO: 883 - DNA, 549 bp, Ctenocephalides felis
gttggccgttgtgaggttatcgtgtgccttgaatcgctcgaatctaagctccatcgtgctaattatttcgataactcccaccccgactgggacatctcgagagtcgggaagcccctggcaaaggctacggcgattttgtttaaatcagtgtctacagttgaacgggtccacttggacgggaaacagtgttcatacgagattattatatatttaaaattgattgaaacagtgacaaagtgatatagtaaaatattttactaactgttcttaaggattcgaatcataagatttctttacatgatggctgaaatgaccgccagcacgcgcttcaaacaataacaccaatcattctccaccacaagtgcaacaattgtgaaataaaacttgattttattccaatcatataaactttaaatacagtgcaactaatcaaaataatttgtcggcaattgtaaaatacctaagtgtcgataagtctatatgtgatcaggctaaagccttgaaaaagaatcttagtaggaatattagtattcgtattaattaattaat

SEQ ID NO: 884 - DNA, 549 bp, Ctenocephalides felis
gctactcctaaccaaaaaacacatttttgataagttcgttagtggcttctgtcggattttaatttttaattcaatcttacatttgcagggtcaaataatttaactatttttatttaatacagattctaacgataatcttttattttgtaatatgtctgaagaaggaacaacgagaagaactacgaggtcgcttgccaggcggctgagtactgattcaatatcgcctccagctgcagggactcctggcaaaaaagcgagggcttcaagagttacggggttgccgtctattgcagaaactaaaccgaaagcagttagcactcgtaaatcccgaagattaagtactgacttaaatttagaagaacctggaagcagaccatcaacacctatatcaactgaaaggcgtcgttctcgccgactaagtattgcttagatgaacaacgcccacaatctgtatcaactctcccattggtggagttatacaagaagaggaagacatcaatattttagcaatgaaagatgatataaataataaatccggtatgngtgtgn

SEQ ID NO: 885 - DNA, 496 bp, Ctenocephalides felis
agttacagctcctgttaatgctttagctgaaacaagtcaaacttcatcaatatttggtggtgctaaaccacgggaagaacccactgagaaataagttatcaagttttaacattaattattaaccaccatatagaataccatcttgaatcatgtaataatttttcgattaaaaattctgcaaaactcataacaggcgtcgataatcttactcttgcaataaattctttaactgatatataaaatgtatcaagttttgtaaaagaaaaatcaataattattgatttacagaataaaatatttattttgtttaaaaattgactaatactttgtaataatatgtaattcttatatatatagattaaagagttgttgttagtgtcttttgttttcaaatagttttacactaatatatttaatacaaaacgctttacaaattttacaataattgatgaaaactatttgagattttattctcgaagtacaacttatgtattaa

SEQ ID NO: 886 - DNA, 549 bp, Ctenocephalides felis
agcntaaataacaagactgacagtttagttttaacaattcatcatgggcgatggaagagatattgaacgacagccattgattcaaaatgatggaactggaagccttaggaatcaaggatcctatacggaaggttctcaaaccacgacggtttcccctataggtcctgatgagttgccaccgtcttaccagggaagttcggccagtggcgtgcccatggtcacttgcagggtgtgtcaggccatggtcgatatttcaggcaaacgcgaacagcatgtcgtcaaatgcaatcagtgcaatgaagccacacctatccgcaatgcaccaccaggcaagaagtacgttcgatgtccatgcaactgtttattgatttgcaaaagttcatctcaaaggatagcttgtccgagaccaaattgcaaacgcataataaatttagcacctagtcctgtgacaccacctgtcctcacggtggaaattttcgtgccaggaatgtgcagggtttgtgtgctattgtggggancgtttttttcaacaccctaacaatgcctcgc

SEQ ID NO: 887 - DNA, 549 bp, Ctenocephalides felis
gctaataatgtgacagccataaatattgtagattaatgtagaataatttgtattgagatttagattttgtagcatactagaatgttatgtgtgcttgaataatgcaagtgagggaaccaataatttggtctgtttttataatacattttagataataattattggtgaactcaatcttgcatatacgccgctaatgaattaaaccagcaggcatataatttttgtacttaaatatttatataactaaaactgatacgggttacgaaaaacacataactatattatttatgtttctagacccgcatgaattaaaacgaaaacggcaaaaaattgacggggatccaaaacatcttttatggcaactgcagggtcaaaatccttctacgagtaagtcattttcaacttttattttttttatcagcaaatcaaacagggttcaatgtcaggtgacggtgaatcacggggtggatgaatataaaaactcatatcatacgcttattacatataacactaccattttcatattatcagtaattttctaggagnata

SEQ ID NO: 888 - DNA, 549 bp, Ctenocephalides felis
atggcatcctaaacaatataataatataataataatgaatggcatttctcgctaacagatattttaatatagcgatttgaatagttttaatttatttgaatattgttcagagtgatactttttatatttgctgtaataaaaatgattattatgataacttatattatgaaagggaaaatatatttaaacttttaattgattacccaagaggatattgatttgtatatatctacttgaatatgaatttgaacagttaacattatcttcaaatttttaatataatttaaaattattggttactagcaaaaacgtcaagatgtctaattacgtgttgaaagtcaaatcaaaagaaggacagcatattttaagagatctcaaatcttccatgactctgggcgatcttttactgaaactttcatgttgacatcgatatctaaaccaatttgcaaattttatcgggttttccgcctaaagcattagatttatctgatnagagtaagactttaaaggngagtgatttnattcaggagatctgtattgtgaaaaaat

SEQ ID NO: 889 - DNA, 549 bp, Ctenocephalides felis
gagaagggaaactgatcaccatgaaattcgcagtagcaattttgggcctggccctgtgtggtttggcatcagctcagttccagaatggacgcatcttagaaccaccagtacctgcactctgcgcccaaaggacgatacacgaacgtagcccagacggcaaaggatacttcttctcgtggcgtgacccacaattggctggtgttgaggaagattggttgggcgtccgcaacttctgtcgccaacgttgcatggacagtgtcagtttagaaaccagtgccgaaaatgaatggatcaagcaaagaattgtcaatggaaatgtcaaatacatctggaccagcggtcgtctatgtgacttcaagggttgtgaccgaccagatttacaacctgtttccgtaaatggtggttctggaccgctgaattgcaaaaacttgcccaaccacagacagacaacaaaacgactggtctgaaggagtggtattgtcttcctcaccagatacaagaattgaacaaggtggacaaccgaaactgtttgcagtttgacactttaca

SEQ ID NO: 890 - DNA, 549 bp, Ctenocephalides felis
cgtgggataaaaaatgaaattatcaattattttactttttgtggcttgtatagccttggcttcggctgcaaatttaaaacaaggaaggaaagctaaaagatcgggtaatttggtgatgaaaaaatcaccaagaggttctgaaaataatatttttaacactggttttgtgaaggattccatcgatttcggagcaaagactttaattcgtgccataaatttagcagaacccttagttcgtgatagttttgacctaggaaaagatgtaaccctacgtctgatccgaggagcaccaattgaccaacatggaagagcttctgattctgaactttttgaaagattggatgaacttgtccagaatataggaaaagcttttgaagccctatttgataattctgaaacaaatgcgaggaaaggacctccaacggaggctagggttccatactaataataatagtaaaggactaagggtgagaaaaaattttttgagggcaaaatggaggagaaggatgtgtgaatttgatgtctcaatataaaaaaatgcatnaatag

SEQ ID NO: 891 - DNA, 548 bp, Ctenocephalides felis
cccttccccccttccccacaaacatcacgtgtatttttagttatgaaaaaaaattgtaattattttgatttttggatttttttaaaaaaaaattctctctccctaaaaacatcacctgattaatggacgcatcctatttgtattccttatataaaaataaaaaatgtgaaatttagatatactgaatgattactcgtaccaagagtcgaaacatataaataaataatataaaaatcaatttaccattttcaaatttgatgaattggttgcaaactataccaaattcctcaattccaatcatattcatatacaaaaatacctatcaaattttccgattcatttaaaaccgattacaatcaattccattaggcaccagtatttataaataaaattttgcgcatatgtgtgaacatatattcattattttattagtctgagaaatagatgttgactattcgagagagcagcgaaatgtcgatatttgccacctcatcagatgttggataaccaaccgntaataaccgatttttagggggatgttaangcct

SEQ ID NO: 892 - DNA, 549 bp, Ctenocephalides felis
tatttttgggtcttttatgttttacaaaaaggatttatcgttttaagtttaaataatgacaatcttacaaattaatctaaacaaaaatgtaacaatattgctttaattaaataattcgtttattgttatattgaatccacaaatatgaattgttgattattagcatcgtttatttttgttgtaaataacttatgcaaagcagagttgatcttataaaacatctaatacttattttattatacatagtgtgatacttgtttttattttaaatacattacaaactaaatgtagttcatctatgatttacatgaaaaaaaattagttattatttgttagtgtttaagacattttacgcaatatggcagtaaataaatgcgcacactaaaaattattattaatatttttataggaacgaaagtctataattctatacactacatcgctttgtgcaattgaaataatatttttcattatattgnatgaatttagtatatcaaaacatttaaaatggttatatgtatacaggtncattattgtaataatgagaag

SEQ ID NO: 893 - DNA, 549 bp, Ctenocephalides felis
gaacagttggataaaataaaaaattgtgaactaaaatttattttcaaatttcattaatttttaacaaacccttttccgtaatattgacggaacctgcctaagtgaagcaaaggacgatatcggttgtcgttggtagtgtagtgaaactataaaattgtgaataaaacttaaaacatcaccaaaaataatccacacacttgcagtaaacaaattattatttgtctctatagacagaaccaaatagaagaaaaactcagctgccaaatcaagattgacataactgtcaattatttttatgttgatcatttattaatatatcaattttgactttcatcgattctatctcggccccccttcccaccatgacgctttcggccaacagcaatgctaccaatcgcctcgggtcgcagcagggacgtagcctcaattagccgccgtgcgaatacaggccggcncagaggatatgcgtgcgcaagcagtcaaacgttgcaaaatcaaagtgacggtgcaagagacagctgnagaatctattgacagagatacgcgcat

SEQ ID NO: 894 - DNA, 549 bp, Ctenocephalides felis
attagacttgccacatctaaataatataaaaattagtaaaataatttgtaaatatttatttaaaaaataaaattaggattttttattaatatgaaataataaataatcaaataaatttagtgtaaataataaaagtgtgcatgtgtcattcttgattaatattcaacgcaattaaagatcaattttgaatgtatcctctcaaaaattgttgtatgaggagatgactagcaaattttttataaatgtcgtggataaatgagtttcgaaaatttattttggattttataagaactgttttcgaattataatagagggaagagctagaaatccacatatcaaaattttaaatggacctgttatagaagaaaatgaaactcaacaaaggaaccatgaaaaaaccngagttctctacaattgcccctgtgtcgaagaagacgatgatcgagtatatctaatttgaatcagatctacacaaatgagtggccatcctgcccattttatagactcagacaagcggagggcccttgganggcagatgaaattcccant

SEQ ID NO: 895 - DNA, 92 bp, Ctenocephalides felis
taaaatcatctccttttgataaatcaaagctcttgattaacatttcttgtattaattttcgcttcttgtattcagctttcatatttgccggt

SEQ ID NO: 896 - DNA, 386 bp, Ctenocephalides felis
atatatcttacatcgaatctaataacaataaagagttattaattttcatgtcgatgttttagaaaatgattcagtagcaacttctgaattttctttgtaattgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgccattgccctgagttgtgtaaggt

SEQ ID NO: 897 - DNA, 105 bp, Ctenocephalides felis
caggcagaaacgagaccaattactcactcgaagagtggaaggcattgacattgccaagagaatataattccaaaggacaaatcgactacagctcttgcaatatgt

SEQ ID NO: 898 - DNA, 498 bp, Ctenocephalides felis
aagttttcgcagtttacaaatccagaagagataccannngcaacttcaanatcagatcaatgagtgcagttcanaattaagaatgtctagttcagagctaacaaagctgctancgtcattatcaagcatattgagcgatcaatcatatatccaacagnttcncgatatcaacgataccatcactgagatgtcagaagttgaaaattggaagtcatcaacaaatgccangtcatcaangaatggcacgtcanaaataantntattaaattctttttaaaatttatgtattantaaattgtnatgtctaatgcttcatattantattaagttttcaaatttttatgttnttttttgtactgtatnaagagtttacttanttttcntagtttgnnatacctgggtaatttgtacctattnangaagcttaagctcgnngaaaactannccttaccnntatcagtgctangtattttnacnncaannataacangcttngag

SEQ ID NO: 899 - DNA, 359 bp, Ctenocephalides felis
cgtcaagtccaatccaagagtggaaactttttcaggaaagctactagagaggtgtcatttccaccagtgggatcgagaaataatcgcacaattagctgtgttcgtgccctggaccaatatgtaaatggccaaggaggctatgccactcttgtcaatggtggagttggctggaaaaatgtaactttactcctatcttctcagactggcaaaggatttaacttcttagttgaaatttggggatattagattagaaatataatgaaaatgtgaatatagaaaaaaaattaaatatacaatagtattttaaatttggcacacatctatctatgcatccataaataaaggttatatacagcatt

SEQ ID NO: 900 - DNA, 353 bp, Ctenocephalides felis; identical to SEQ ID NO: 490

SEQ ID NO: 901 - DNA, 498 bp, Ctenocephalides felis
aagttttcgcagtttacaaatccagaagagataccagagcaacttcaacatcagatcaatgagtgcagttcacaattaagaatgtctagttcagagctaacaaagctgctatcgtcattatcaagcatattgagcgatcaatcatatatccaacagcttctcgatatcaacgataccatcactgagatgtcagaagttgaaaattgaaagtcatcaacaantgccatgtcatcaaagaatggcacgtcataaataattttattaaattctttttaaaatttatgtattattaaattgtaatgtctaatgcttcatattagtattaagttttcaaatttttatgtttttttttttgtattgtattaatagtttacttatttttcttattttgatatacctggtaatttgtncttanaaagaagcttaagctcgtncnaaactatctttatatttatcaatgcctangtattttaagnncannantanaatgctttgann

SEQ ID NO: 902 - DNA, 498 bp, Ctenocephalides felis
tttttttttttttttttttttttttttttggacggcccaaacnatttatttttattaaaaagntanatgtaatttcataaagcttctatatttacanantttanataatcagaaattactatagttaatgacantttgtttgtgcnccntacataaaatacaattttatacattttaatttttatacatattttttaaanntaantgcacagatcatttgngtatttattatattaattgactactttatganaatttgaatcctaattagtctattcaagattgttttcctggtttaagccttacttancaatctcacttttgcattcttcgccgggtggcgtgggtangcancgcaactccgttttatcaaagtgcaagccanttggacaatcanaagntttatttgccanttggttgttaaccaagnnnccattgntaacantttttacantctcttcgatnngaaaaaaacgttttcacctttgcatgcagttc

SEQ ID NO: 903 - DNA, 500 bp, Ctenocephalides felis
tttttttttttgtcatttttaatttatttcatcaactacattgaaattaaacaaataaagaactattattcttaaattaaagggaaattttacatcagtacattcaacatgaatcaattctaaaattatgtgaataaccaaaattttaaaccattaacacaaatattttttattcccacttaacttattacttattaaaatattacttggcaagtatttttatatttttgtatttttttaggtatattataaagacgcctttagttgttgccttatgaataaaatacatatttataatacattcacatattacatactaaactattgagaagacttagacgatttaatggaattaatatgaaggaatttattaatttaaattttataaatataaaaaattttagtgctttttttangatatcctangttatattanaattcgttttcatttacagatgtggcatatangtatantttttgtnanttaatttttagttatt

SEQ ID NO: 904 - DNA, 440 bp, Ctenocephalides felis
antaattttaaaattaatctttcaagttattctgaatcgtttgacagaaaaaaatttaaaaacatgttttcttgttttactaaaaaatgtcgttattttttcaatgaatattgaaagtgtttccaaaaatttctaagttaatttaattaattttttaattatttttattcagatgttgtcacacaaaactatttatatatcatcatatttantttgtatatattttctatgataaacctgtaaattatttataaaaagaagccaaaaaaaagaatttgtagtgaaaaaatatttcaaatttgaaacacaaactgaatgttctgaatgttaattatatgtgattaaaataataaacatttattgaaatattaaaaaannncaatacaaattatggtagatagtagaanccaanngcataanaannancncaaaaaagcttg

SEQ ID NO: 905 - DNA, 494 bp, Ctenocephalides felis
ttttttttttttttnnttttttttttgaacggcccaaacgatttatttttantaaaaagatacatgtaatttcataaagcntctatatttananattttaaataatcagncattacnatngttnacgacattttgtntgtgctccttacatngaatacaattttanacattttaatttttatncatattttttatatttaattgcacagatcatttgtgtatttantatattaattgactactttatgataatttgaatccnaattaatctattcaagattgnnttcctggnttaagccttacttagcaancncacttttgcattcttcgccgggtggcgtgggtatgcatcgcancnccgttttatcaaantgcancccgatttggncaatcataatgtnttatttnccncntgtngnnnnccccagaancattgntcanacttttnacaancccctcnatngggaaaaacctttcacttntgcatgcacttc

SEQ ID NO: 906 - DNA, 498 bp, Ctenocephalides felis; identical to SEQ ID NO: 182

SEQ ID NO: 907 - DNA, 215 bp, Ctenocephalides felis
agactgaccctgggcccaggcgtttgcttaacagtgacgttaaagacgaccaaccacagtcaacgaatgatgaaataagctcatccacaactgctccaagttcaaacgtgaatgaaagcaatggaaacctcaccgaatcacaacccttaagccaaaatacttcaacaaatactccattagaaacatcaaatacctcactagcagaaagcagcagt

SEQ ID NO: 908 - DNA, 498 bp, Ctenocephalides felis
taccttttgctaccgatgctcaagggcgataacggacccacagcctggcgtccaaaatgcttcctcgtccgcaacgacatagtcgttttgcaagatttatccatgtataattttcgccattcgtatccaaaattctctttggatcttgatcatgttaaagttgctttaacggcattggctcgtatgcatgcaagttgcattatctacgagaagaaaaaaaattgttgcatggggagagtttacaaagatcttatgttcgagactatggccaacaataatcaatggtggagaactggtgaggatactgctttagcaattgctgaggaatctgagaaattcggcaaatataccgaataccattccatggtccaggagaagttaattgatttcctgagattggcatggtctatggtaaaaccatcgcgcatttataagaatgtggtatgccaccgcgatacgcgcaatcacaatttgatgttcaaatataattcaactggt

SEQ ID NO: 909 - DNA, 245 bp, Ctenocephalides felis
tagacatgcaatataccaaagtttctcaggactatacttgataaatttttttgcatggcaaacataagctggtctttcaggttcctcagatttagtcggtggaaagatcgtgttattgtaagacaaaaacttttgtggaccttcagatctatctgtgcgttgcaaggaactagatgtatgaaataaacttcccctaaataatgaagttattttgctattgattagcataagttaagcactctcgt

SEQ ID NO: 910 - DNA, 386 bp, Ctenocephalides felis
cctacacaactcagggcaatggcagtatgtatatctttaatgatgggtcgattaggaagtgttgttggaagcaatgttgtaggaataattctagattataattgcgatttaacatttttaatatcaggaacatctctgatagcatgtggagtgattgcattctttataccgaacatttatcagaagcaagtggatagaagaacgagcattgcttcatatggaccataaccatatttccgtcgtgtgttgtgaaatgcaattatactttgagaaagtattatcgattacaaagaaaattcagaagttgctactgaatcattttctaaaacatcgacatgaaaattaataactcnttantgttattagattcnatgtaagatatatgt

SEQ ID NO: 911 - DNA, 66 bp, Ctenocephalides felis
ttattgcatttggtccaaaaatctcaggcttataatattggcccacagaagaatatcctggtctgt

SEQ ID NO: 912 - DNA, 498 bp, Ctenocephalides felis
tgaaatgtgaagacgacgtcaacgaatggtttgacccaaaatctttctcgtgcagaactgcatgcaaaagtgaaaacgttttttccgatcgaagagattgtaaaaaatattatcaatgtttcttggttaacaacaaatggcaaataaaacattatgattgtccaaatggcttgcactttgataaaacggagttgcgatgcatacccacgccacccggcgaagaatgcaaaagtgagattgctaagtaaggcttaaaccaggaaaacaatcttgaatagactaattaggattcaaattatcataaagtagtcaattaatataataaatacacaaatgatctgtgcaattaaatataaaaaatatgtataaaaattaaaatgtataaaattgtattttatgtaaggagcacaaacaaaatgtcattaactatagtaatttctgattatttaaaatatataaatatagaagctttatgaaactaaaaaaaannnannnann

SEQ ID NO: 913 - DNA, 498 bp, Ctenocephalides felis; identical to SEQ ID NO: 181

SEQ ID NO: 914 - DNA, 123 bp, Ctenocephalides felis
tcttatgatgtagtcttaaataaatgacattatttctatttcataaaatgttactaagattgctcatattggttagaagatttaaaaataaatcagcagcaagataaatgaattctgtaatgc

SEQ ID NO: 915 - DNA, 190 bp, Ctenocephalides felis
aatgtcatttgttttcaaatccgtagctattttagctgcttcagctgatgattttgccacaccaaatggaggtgtcggtatgccaccttcctgcaaaatgctgaaggatatatgctccaagacattgagctttcgtgtttgggtgttttgccatggtgctacggataaaatcttaattccattttttcgt

SEQ ID NO: 916 - DNA, 500 bp, Ctenocephalides felis
tttttttttttttttttttttttgctgaactataacttgctcttttattgctcatcatataaggctcaacagaaaatcattattaatattacatatttttatagtgatttcattgatataaccttacatctattttttaattcatttaatacctagtgccaaataaaaaagttatgcatataagtgttaacaatttaaatgcttacatataggacatttacttgaggccaagttatattgacaatattcagttgatgcacgaataaaataaaatgatttaattataatcattctattcgtacaacgattttatacaatcaatctgaagctacaagctagaattatataaatacattttaatactatacaaatatncagaaatatttcatcctcatcgtcctacacaaatncancctaaaatgtcttacaaggacngtcatatatcacgaaaggaatnaaaattangaaagggattaattaanactacattaataatacat

SEQ ID NO: 917 - DNA, 95 bp, Ctenocephalides felis
tacgagtgcacattaaacgctcaaggtgtattcgacgtggcccgatatgcttgtgcagctgagttatatttcaacagcgttctgcagcagtgcgt

SEQ ID NO: 918 - DNA, 68 bp, Ctenocephalides felis
gaaaggaccattaatttataataattattttaatttgaataaaattaaaaaaaaaaaaaaaaaaaaaa

SEQ ID NO: 919 - DNA, 498 bp, Ctenocephalides felis
ttttctactttcgccgtcaagttttataacgactgaaaattcaataatccaagtttaattggttatatttctttttacagttatagataattctataataagtattgtttgagtgctaagtcagtttctattcttgtttttgtgtgctgtcgatgtcgatatcgatagagccgcagaccttatcaatttcacttatcgttatgtgaaactactttgattgagttagaatttgtcactgagctttatcaaggtcttgtatcatgaaaacagatcggttgcgaaataactggcatagcattctgacacaaaaatactagaatacctactcaaaacgtcttttatgaccgtgcgatgacctttgaaacgaacgttcattagtatccgtatatccgattgatttacttttaacacgtttaattactacagaagtaatatcaaacgaacggctntcgctnaagtttatatgaagtaagaattgtaacaagcaaagaagtataa

SEQ ID NO: 920 - DNA, 500 bp, Ctenocephalides felis
tttttttttaattnttttttttttttttttttactttacnanatatgtnngtattacacaacattttagttgcatatacaagcttaaaatataaatatatattatnaattttagttaaaaaatctaaatgctaggtaaagaacctantaccgaagtanttatggattcgaatataatcnaagaaatanatctaaaggcatttgtatcattcctgcnataatttgtantgaaataggnaataaatattccacaacananctaatgtattaanaaacatttacgtttggtcanccattcataacaatctanatanttcaaaataataaattttacaggaccaaatacatnaagcggtcatttntgtngnantgcacnaggaaacacacatattcaattattgcgccntgtnnctataataatttttgngnncnttntgcnacttattaancaanatttgngagatantatttttcgtttcttttttganacattttttacag

SEQ ID NO: 921 - DNA, 173 bp, Ctenocephalides felis
tttctttagtggtgcactgtagatatccactttgatcagcgcacacttgatctgggctacaggattccttaaccggatctgctcctatttccggacaatactgcatttcgggtgaactgcacgaattcacgcaactaaattttacttttttacatttttgctcgggtttcggt

SEQ ID NO: 922 - DNA, 217 bp, Ctenocephalides felis
cccttcagtatttcttttattttcaattacgaaaatcagaaaacagttattccaagatcatggttcttgttcccttctttaagtttatttcctatcctaaagtgttaactattactacctaaactgcgatgatatttgtgatgaatgatgttgacatgatgtccgaagacgttggctaagatgcggtaaaattctgttcctggtcatcatcgttccc

SEQ ID NO: 923 - DNA, 269 bp, Ctenocephalides felis; identical to SEQ ID NO: 280

SEQ ID NO: 924 - DNA, 303 bp, Ctenocephalides felis
attananatacgctgagactttaacctanttatagacatagaanatataattcttanatattaaaaccttananacttactntataaattgtnatttaaaaacaggttgaatataaagtataaataattatagaagattgatttccntaacagtgagtgttatgttaaaaatatatatttaatacatgaaatggacaatgtttcanttattganacgaacttcttgactatgtctgcaatcgatgactgtgagttatatataaaagttttcttanatacttacgtgtatatatataagtatgt

SEQ ID NO: 925 - DNA, 145 bp, Ctenocephalides felis
cnttacgccttcagtgtgccggaattcggctnancgtggtcgcggccgcggtacgaaaggaccattaatttataataattattttaatttgaataaaattaaaaaaaaaaaaaaaagaaaaaaaaaaaaaaaaaaaaaaaaaaaa

SEQ ID NO: 926 - DNA, 428 bp, Ctenocephalides felis
taagttgtccctaaattctttcaaggctccccttgcgcattttccgacttcacggactaagttgcccaattgggaccaggtttctttgagtgccttggccaagtcttttgctccttcgtgggcagcttggagaacccctttcaagcaaactctggcttcatcgacatcggctgcggtcacaacgcactccttggcttgtgctctgagggcttcggcgttctccctggcttctctccaggcggccaagccattttggcgaacttggttgaattcatcacgtttgtcatctctgcaagccttgaccttggcacgggcttcttgtgcgtagcctagagctttttggtgttggcctttaaggcattcctttgcggcttttttgctaagtttcctttcaacttctttgttgaactctccaaatctctatcgac

SEQ ID NO: 927 - DNA, 118 bp, Ctenocephalides felis
catcaccgagaagaactcttcggctacggaatatcttcattggaggcgcgttgttggtgcacgcagcattaacaaggttcttgcaattcagcataatgaccagaagaaaaatacaggt

SEQ ID NO: 928 - DNA, 489 bp, Ctenocephalides felis
catttgcaagaattatcagtgtaatccaaaaacaatcctgtccgcacgcaagcaaagggttgcgatggtcctggtcctggtggcggtggtggaggtgcagctgtcgccaagcactcggataaaggcgcttgcacgcattgtgggtaaagcgcgctgaagtatgtctgtccggcgcatgtaaaacgacccacgttgaaatttcctccagagagtctcacacattcaaaatatactttgcatgttttgtctgctggatctgcaaatgagccgctctgcacgcagctgtatatgggcggcggcgtaggtggttgccaaggcgctggaggatttcttaggcactccgaaagggaagcgaccacacattgctgatagaagtaagtagaaccaaggacaattgtaacgcgctacactgaatcctccgcctgctttcaaagcacatttgtagtatcctttgcaagtgctgtcatagggatctataaacatcccttc

SEQ ID NO: 929 - DNA, 409 bp, Ctenocephalides felis
gactcgtaattatatattaagtcagtttggagaacatactaaaaacactaatgatataatcgtaagtgaaaggaaattctcaataaatggtgaaattctagctagtgcaaaggttaatttaggtttggctatgtcacaggaaaagtttttaagtattaataatttcattttgatattacaagaaatattattatctgtgttgtttaatgatgataaagggaatcacattgtatagattttcaggaactgtcaaatgacaggcaaagtataatcatgattaatgataaaattctaaaaagcaaagggataaaacacccttaatgtgcacttgcttattgcatttgactattctgaaagagatgtcaatagctaatgtcttattgtagatgctataagaaaactattaagt

SEQ ID NO: 930 - DNA, 349 bp, Ctenocephalides felis
taaaacgaactctagaatattcaaacttagctggaggtgatacttccaacatgaaatatattgagctaaaattaatccaaagtaaaaaagatatagaagatccacaattatgctgtaaagctgaggtagtatcttgatatgtgaagttcttgaacataattgtgttcttaaaaatatgaaaatttgtgtatttatatttaaagtcaacttattttctaaaaattacgatagcttataattatgtgttatgtgaatatgattatcaattgttaaatcaatgtattctttatatgttactattatatattattaaattaanaaaaanaaaannaaaanaaaaaaaaaaaaa

SEQ ID NO: 931 - DNA, 382 bp, Ctenocephalides felis
taaaatcttgtggagaagaatgtgtcattgcgatcaaaaccaacacagcccttgataaataatgtatttttcaacacattcaaaattaaaatactatgagaaccaattcaaactgtttaaacaagtttgacaaagttgtgtcgttgataatcctagttgatgtattgtctattaaaatcctgacacttcaagcattgtttatgaatatattgatcaagaatacaaggtttttaagttctctctggaatattttttgttcttccagagatgtttaattgacagttgtcaatcaattgggtttttcatagacatacattgtaacagtatgcttgttttaataaaatcaatcaaattaataaatatccatgattatgaattaaaa

SEQ ID NO: 932 - DNA, 313 bp, Ctenocephalides felis; identical to SEQ ID NO: 184

SEQ ID NO: 933 - DNA, 85 bp, Ctenocephalides felis
tttgatcaataatcttattgatcgcaaggtttgtgctgcctcgagtaaagtgcacactacgagaaaagttgccaaaggaatttgt

SEQ ID NO: 934 - DNA, 446 bp, Ctenocephalides felis
gaggagactttgtttaccgtaatggacaaccattcgaaattccaaaaggaaatttactattgaatgattaaatgtaatagattaatcaaattttagattattaaaattgttctattactacagtagcaacctcagcctgaaaattaaccgaacaaatttctaacccttatcaatgtatagattttgaaaaataacatagaaatactatttttttgatgactgtaataaaaaaatgtataaatggccatacctgaaaagatttctatgtgtattttttattaccttttattgctgaatggataaaagataaatacaatttcataagctcttggattaaattaattttgaataaatccataattataaaatatcaaattgaaatatggaactacaaaatgtatacgaaatataacttatataataaatganaacnaatnntgccgncc

SEQ ID NO: 935 - DNA, 491 bp, Ctenocephalides felis
tttttttttttttntttttttttttntttgtacancatataacgttatatttcgtatacattttgtggtttgtggtccatattttaatttgctacttaacatattctatgattatggntttattcaaaattaatttatccaaacagcttataaaattgtatttancttttatccagttcaacaataaaatgttaacanaaaaatacacataganatcttttcanacatggccatttaaacattttttcattaagggtatcaaaaatatancaggcatggncatttatacattttttttagtatgagccancanaaaaatantanaatttcnatgttantantcaanntctanacantnananngatgttaaaagttaattttcangcagaagttgctactgnactnatnnaacaattttttcatccanaantngntnaacccacnncatttaatcatcacnantaaattccgnttggnattncgantgggt

SEQ ID NO: 936 - DNA, 323 bp, Ctenocephalides felis
aggtcaagagatatagataaatattttttataaatttcttccttgttatcaattanattattataanntatattagcaagtgtattaataattatctcgaaatattatattanaattaaagcagctcgactcacaatcagtcttganacaaatgtcggncgacatattgcttttacacaaatcgattcacttttacacgtggtgacttgttcatttgattcgtcatctcgcgcattgattcaaatctatcccgcanacttttggcactttctaattgtgagtcattattttcagtttgggcactcttcaagaacatttatcgt

SEQ ID NO: 937 - DNA, 386 bp, Ctenocephalides felis
aggnaatggcaaaaactgtgtctagaactttgaaaaccaaaatttcattttacttattaacgttttcaaaactttaaattttgtttttatttatcaatcgatcaattttgtctttcttttttgtcttgaaacaatttagagacactgtaatttcacctagcacctgattctgtgattacattataattagaatattatcacgcggattattaacacaatttcatcgtgaataattaatataacactagaatacagaagacgcacgtgcatgtattttaaaatcatacacgcgacaatggtgggtggtttacaccatctgaatccggttcaacaccggatcaggtgagcgtctttgctaaccattaaagggtggaacaaggcggggt

SEQ ID NO: 938 - DNA, 385 bp, Ctenocephalides felis
tttttttttttttttttgccttagcatatttgcgagcctgngttcaaccanantatttttttatataacacataaagnanancaaagtanatattttgtatagtttcttttgtngagnacttcatcaatatantaatataatttangnttcctcncgcangttcccgtgttgcancnttgngtatcttggntaaataatgttncaatcggacattgntcaggancnggntcccctttagggcgtaaacacgtgaaaaacttccggcatgttncgtnggtctnnaaancacattttccacgtnctcngnnanangtttctctccttggggaaaactcggcgggttcttcgcattgcaatacggctccncttccagcaatncatacc

SEQ ID NO: 939 - DNA, 489 bp, Ctenocephalides felis; identical to SEQ ID NO: 329

SEQ ID NO: 940 - DNA, 478 bp, Ctenocephalides felis
gttcattttgtatgaaactttcagtaagaagtaaggtatccttttgtgaatttgatggtctttctttcactgatccaaatattggttcttcgcgattaatatcaacatttaattctttttgttcattacttgtcacggttgttgaagtagtgattactgtattaatatcttgcaccgtgttaatatcttgcaccgatgatgctatctctggaacattgctaatatcttgaggttctgaaacgtcttttgatcccactgttggttcacatttagtaaattccaaagtaaactgtgtgacgggtttcattcgtataacttcgtgggttatgagacaaatcttttgagttttgttttcatctttaggaaaatcgtgtgaaattgatacgtcataaatatcaccaacttttcctgcaacttgcgatgtgtttgaagtcgttatagcnttcgaggtcctcatttcattgggatcaatagaagt

SEQ ID NO: 941 - DNA, 139 bp, Ctenocephalides felis
ttaaagaggatcaacaaaacatggaagacgaatcggtagtaactaatgttcgatctccgccgactggtatttggcaaccgattcctaatgttcctcaaatgccatggatgccacaacagatgatcagaccgactttggt

SEQ ID NO: 942 - DNA, 390 bp, Ctenocephalides felis
cgatttttttgtttaattttttgcaaaaacaaaagtcagccactttcggcgtgcatcatttataaatgattcgacaaataaccaaattcctcgaagacgtctccgcgagtgcgttaaagttccaacgggaattctacaaggcaaaatcgaaagagttcaggatgctccttcagcagatctcgaggagcaggcaggggacgatttttaagaaacaaccggctctgtggtgtctggtcggatgtctagtaggtggttttagtctggccactctcagcctggcccgcaccgtcaagaatcacccggacgtctacctgatccgcagccactcgggcgaggagcgctactggcgccgatacaccaaactaatcgacgtcagcggatcgcgcaagt

SEQ ID NO: 943 - DNA, 274 bp, Ctenocephalides felis
acatanactaatgccgcgtttaccactgtcacagcaattccgcataaccancaaccacaaatatanatntgatgctattgttaaatgttcaananntgcacanattattccacanatctcgcatgataccatcacgantacaacgaattggaagctttcccacagnagttaataanagcacctattatgggaaatncaatcgcatatccagcttccaacattaanggaatgcatagnatgcctgttcttccattgtgtctttanactcggtcgt

SEQ ID NO: 944 - DNA, 598 bp, Ctenocephalides felis
tatttttgcaataaaaaccagtaaccagtggcacacaaatttgtaatgggcatgtttcattatgatcgatcgtattttatattaagagcaattacattattaattaagatattacattctcttgaattacttcttattctttggaacctctaaaagttcttccagtagttcatccatagcttctatcaagctagtacgataattttcattgttctccatgagatccaaaacagtctgctttctcattccattaacagtacgatcaaactcctcagaatcgtggntcaaaactgccagtatttcaggaggcatttgagtaagaggcaatgtcatcaccgccaaaattttagcgcacaaacgcaaatcatccgtgctancatcaaactcttgttcaggaattatatcgtttacatccaaattttccntcgtaatgttttccacaaatgctgctctgtagaacctcttcaatcctggtagngctggtctctaaagctccanatgttgtcgatatanaagatgattgnatccanagctggtggattgttgtgcatcttggantcgncaagatgcattgtnaagtanacanttgnataganct

SEQ ID NO: 945 - DNA, 167 bp, Ctenocephalides felis
ctgcataccagtcagactgtttaggtgcaagtgtcacttcttccccatccataccatccttaccatccttaccatctttcccaaccttgccaacatcttccccaacagcaggatttccttttggccgaaaatctcttgatatgcaaacaaaaactggaactaaatgt

SEQ ID NO: 946 - DNA, 160 bp, Ctenocephalides felis; identical to SEQ ID NO: 452

SEQ ID NO: 947 - DNA, 193 bp, Ctenocephalides felis
cctattccgtcacctacgcctctgtcgaagtcctacaagattctgaggttggacaggctttcatcgtctccggaggaatcggccaatctgaaatccatttggctgttgtagctgacaaaattaagcaagtccaatatacctacgaaatctacgccattgtctacgtttaaaatccttaaatgactgaaattgt

SEQ ID NO: 948 - DNA, 413 bp, Ctenocephalides felis
acacaattagcaataggaaaatctagccacaaatatttttaacaatttatttaatacttatgttctagaaatacaaagtgtaaagttcaaggtttgtatagcttaataaagtaaacattttaaaatgtaatgaatttatctgcaaatagtcaaaatcaaaattactatataatgattattgaaataatgcttttatagattgcatttcaatctgtattaaattgtatgtaaatcacagcacaagatctaacacacaattcatctaacagaaagaacaaaataattttaatgttattaaaaattacatataaaataacttttacaataaagtaaccttacatgagatgtgttgatttcagatacttttcatacaacagtgctttctgtataaacaatataatatanataacggt

SEQ ID NO: 949 - DNA, 237 bp, Ctenocephalides felis
aaacctattaattacaacaattacactaaattaaattacaattaattcctaaactaacaaattcacttccacgtgtctgtcaaaaataaaatcactcacaaatctttaagcaaacaccatgacaagttcactcttgatgacaaagttcttatcttttatttacaattgtctttgcacaataatggnttatttaatttaaatcactttgattgatttatgtgatgttcttcatctggt

SEQ ID NO: 950 - DNA, 131 bp, Ctenocephalides felis
attgtctttggagtctcaagaactaattccagttgaaacaaattccagcagcgttcgtatttggcagcaaccattcatttgtccaagagttggactatttcgcgatccattggatcctacatgcaaaaggt

SEQ ID NO: 951 - DNA, 204 bp, Ctenocephalides felis
agaaagctgaaaaattagctaaggaagcatctaattaaatttataaataagtgttcaatcactgaccattcaaaattttaacctttttttacattatataaccacactttattcattatagtttatataatttaaaacaagtagaaaatccacaaacagctttgtgatcagtgattttactaaataaaaaaatatnaaanatca

SEQ ID NO: 952 - DNA, 598 bp, Ctenocephalides felis
tatgatgtgctaaagtgctttgtaattaaatctaaatgaaaatgggagattcaaaagcataaatgaaaaattaccctacttcccttgcaatttgcatcaaaactcattctttagagatttcgtttattaagttgtaaattatatataattaagagctaatgatatttataaaaaatattacacaaaataattcgtcaaacatttaaacaaaaatttgaactttccaatgtatatgtataataaagggaacattaaaaaggaccaattcaaaggaacgggatgaggctgacatggattaagtagaaaaaaagaatataattgcaacaaccggagatcttcaatttgggtccaagtctcaattcaacaaaggaatgttagtgaaattttgcaatagctatgtgaagatatgtttagctatgaaataaagcataacanactaagaaaaagttttcttacaacacagtgcagcaattcttattgcattagtcaaggaaaaaaaacataaatcgaagttgtccactgaagtggtttgaaactggntccattcataaatatttgatttatactttaataatcatagtgtnntagtnngtaatac

SEQ ID NO: 953 - DNA, 138 bp, Ctenocephalides felis
taattaattttaaaaaattaaggatagaaaccaacctggcttaaaccggtttgaactcagatcatgtaagaattattggtcgaacagaccaaattttaaaacttctgcattttaaaattatcttaatccaacatcgag

SEQ ID NO: 954 - DNA, 429 bp, Ctenocephalides felis
aagagtatctttcgaatgcaatcaaggatttatcctgacgggagatccaaggagaatctgtctcgatgatggctcttgggacgttcctgtttatggatatactgaatgtttacgtgaaatattttacactactcgctcagcatggttaactgccggaatcatctttgctgttatggtacctcggccgcgaccacgctcgagcggccgcccgggcaggtacggaagcaccttaggctgtgcaggacatgtaactgtatagcattttgtgcccagagccataggtccgcaattatgacgtaacggatcatatgcaaaatttgcggggcaataatattgggttcctatactattttcgtcacaataataatagctttgacaatcatttatatttggataaaatctcgatggtgacggacatttgaaaccttg

SEQ ID NO: 955 - DNA, 296 bp, Ctenocephalides felis
caaantataagataccggaaacatttanataaacgatatatgaatatttaatacatcatnaaaaagaatttattaaattaanagaaantggngatctacgtcaatttatctaaaatagtttttaggtgtaanaacnattagaactaattctatttgtttactacttttgttnctcgtatttaggttttgntttaaattangtatgttattttagaaagcactgataagtataaggnattgttganctgtattttanaagactgccangcaantcacgtttatttannnaanaangt

SEQ ID NO: 956 - DNA, 221 bp, Ctenocephalides felis; identical to SEQ ID NO: 328

SEQ ID NO: 957 - DNA, 126 bp, Ctenocephalides felis
tggcactgcttttcatcataatacagtcattagcgatgacatggtattctttatcatatataccctatgctagggatgctgttaagaaaactgtctctagttgtataacatagtctgcttagcagt

SEQ ID NO: 958 - DNA, 337 bp, Ctenocephalides felis
cgaggggcttatgaagctcactggccatctttcgaatgttttcagtcggtccgcttcgattttcatgtcaagattttcatcgtcgccattgtcgggcacatcaatgtccgcggactgtcctgtttcatcgcccgtttttgtaactgtttcagactttagattgattatatcgtatacttcgggtctcgtatcgattgttgtattgtttggaggcatttgtaatgcgtttagagactgttttgatgcacttttattgttaaaaacatcgaacactgggcgtgacgcgataactttgttacactttagcccaccgttaacattgaacgacacgaacagt

SEQ ID NO: 959 - DNA, 498 bp, Ctenocephalides felis
acatacaccaaaatatctaaagctaaatatttggctcttacaattgataatttgtattanaagcatccaatgaagcatcttgtaaacaactatgcatctgtgaaatctatgttgattttgaacatcagattggggatgtcattgaaacaaaagttaaagacagattcattactgaaaatctgaaaaacaaactgaaggaatttgttgcacatttatctgacctcccaacatctttaaatatgatctagtattaagcataagaattcaanatatacaacctttccgttaccaatctaatgtagacaaaaagcaattactggcaatatttaaacttaattttgcatatggataagtcctattgtttagccaacaaacannaatgctgacaatctantatgtctgaaaaacatcaaaagctgttcttttggnaacacatcanacacagtattanncanacctttctataaagctctannnatatnnnanagttagannact

SEQ ID NO: 960 - DNA, 498 bp, Ctenocephalides felis
agcatttttggacccttttcaataagagaaaattttggtagtagttttatgacacaactctctggtgtgccccaatattgatgactttccttccattcgcaaggagatccaatacaaaatacatgcccctcttcactgcgcattaagactagagtaggacccttatatgataaaacatgatgcaaaaatctattcattcccaaaccgtgttcccttgaatcataaagtaatgcccaatgagaaggcacaacagatagtaatttagccatgaatgcttgtgaggctaaattaactccagaatcgctaggactagaagctttgactggcttagaatatagaggcggcaatgcacctgctagtaaccatgcaagcgatacaggtaatagtggaggttcaaccatttttccaaatggatttggtttatccaaaataggtgtggataattccaaacccaagccctcctcatgtgtgtcaatacctctgtatgatgtgcttaaa

SEQ ID NO: 961 - DNA, 414 bp, Ctenocephalides felis
aaatggaataacactataatttctgttacattatagttaaagtgtaaaaaaaatgagtgaaaatatggcgtcccatattccttacaataattggntcacttacaatcagttataacatctgcatacaaaatgtnggtatttcaattttatacatacaanacaaatttcatttacaattttacgtagttattttattaactaattgataataaaaacccttttaagacacaaaaatgtgtgtgaaatttanttaatacntatgaaaatttttaaatctttantgttaacantgatttttttttaaataggaacancttaangcaacattgagaaaatcttcgacngctattgttatggttcctgtttgttgggaatctcgttgtctgaatgcttcctgtgagcctctgtatttgn

SEQ ID NO: 962 - DNA, 234 bp, Ctenocephalides felis
aaaagtgntttaccatagangtttgtgaaagacctgngtgtcctcaacgctttatcagacaaagtcttagaactaacccctgatgaacgtcctagcttattcttcttccgcttancantaaatttcaaatcccccgnagaaancgnnaaanccaanactgaactcaccaanggcatcaancancttgagcgaagccttcgataaaacctananaggcaaagtgctgttcaccgt

SEQ ID NO: 963 - DNA, 379 bp, Ctenocephalides felis
taacctccaatgacgtcttaacacgtaaaacaaggcaagcagatgatgccccaaaagaacccgatttcaacctagctaaagaatacaacgactcctacccggtggtttttaacatcatcttatggtttggagtagcctttttcttctcgctactagctatctgtatctcgatctccacaatggaccccggaagggactccattatttacagaatgacatccacacgtatcaagaaggagaattaagtttgtgaaggagtgtttttaattgtaaatagattgtttagtattattacaatgcaacgtgatcaatattatttaaaaatacaatatctttgttgttacatatttgtttaacattcctcatattaccgaattgt

SEQ ID NO: 964 - DNA, 462 bp, Ctenocephalides felis
atggtgcatggatgcatttcgctgatcggtaaaatacgcgatacaaaaaattaacaacgttgcgcgtctcgcgcataattacngttcnanaattctcaaanctttantcttctcntantanaattatgtgtatttagtcncgcgacnatanttatacgtttcgcgctatatatanaataataaagattcattacatactcaaattactattacnatatacattttgcantgacaaccatatcnttgnncatgnaattatattgtnactgtanattcaatacatttctctttatttaantttgnaactannancnaactaactattantactcgcattanatccannnttatanctatncctatnntcgngttttttacttttgtcatacactttncttttnttttacttgantannatcncttaaaacgntnanaatnannccnacatctatnttagnaanc

SEQ ID NO: 965 - DNA, 258 bp, Ctenocephalides felis
gtatatacaataatcaattgctaagatacatcaagcatatgtcatacatactgtccccaattttggaggttttctaaaacaattatgaatataatgtatttgttaccaaataatttgcatatggcaaccatatatgaagatctgtatattgttcatggtttcattccaattctgcacgactcatattcagacaatcatcctcgagctaatcctctccaccgactaatttaagagatttaagaagtgaagttatgtcgt

SEQ ID NO: 966 - DNA, 134 bp, Ctenocephalides felis
aanaccangaacaanacttaggaacacaaggttttattacccaccacaattttgctggacaaaaccctagccaaagtggtttcaactatcacaccagcaatttccangcaagggctaatanacactgnnaatgt

SEQ ID NO: 967 - DNA, 462 bp, Ctenocephalides felis
aaatatgaaatgtttccgacantcattaaaatttcttttattcaaatacaaaatgtagcanttaanaaaataatacaacaattaactgtcagccattttatcttctgagcaaaataacctttttaccatgtttatcnaaatttataaaattgacctttaaacctttcccgatttattaaaaatggatttgtatataaaattaaatgcgcaagcaggaggcagggataaaataattagtatatgagcagaactttgtgggacttcctgcagaaacatggacaacatcaggaagtaattgacaagttgaaaagtttggagtttacattcagctcattcaggaaattgctgcgtttgggaaaatgcatanatgttttcnactcttcattgccaactatacattacccanacccacaattnnaactacattngnnattgnncacnccttntttgnnttanntttan

SEQ ID NO: 968 - DNA, 470 bp, Ctenocephalides felis
tactttcaccaattacaangtaaatctttcaggaaatcaatcangaaattattantttatgagtataccgagttgctctatggacttaagatgttagacaaagttgtaaattatttaatttcaaacaaatttgccaaatatttcattcanattaaacaaaccattcaaaagttacaagaattttaaagttagnaaacattgcgacaacgtantgtcnacatcaatttaaaattantaatttttcagtataccgagttgctctatggacttaggatgttagaaaaagttatagactatttaattttgaacaaatttgccaaatatttcatttaaattaancaaacagtttanangttacaagaatttgaangttagtaaacattgcgacaacgtagggtcgacatcaagtannnattagtaanttatgagtataccgagttgantagggacttttggaancgatntngtgt

SEQ ID NO: 969 - DNA, 397 bp, Ctenocephalides felis
atcatgctgagctttcaattcccaaaattggcgcatgtttcctaaaggctgagattttttatctttaggaattgatattccagataggtcacgatctgcagttttaacccaattctctagtctgtcacttgtgatgtcgtatgtagaccatgtatcacggaacgccattaatctgcgtaaatattcaccaacctcatcttgcaggtgtagcaatacatccattgcctcattgtgtgcttgctcaactcctggacaatcaactaactcttgaagtttttcagtcatcaaaaccaattgttgcaatttagcgtgatgatgagctatatctgaactcanagattgatataatgtgatgtattgatcataatcgactgtcgtaactgcagacaaatcaggt

SEQ ID NO: 970 - DNA, 340 bp, Ctenocephalides felis
gaatactggttcataaaatttagaagccctaatttaccgcctacggcgatatgatgatcagacatatgtccgggcttgtccaaaaatgtaaaatgcacatgggaattttccaatggcgtccacttatgaataatattgggaagtcctagcaattgcgttatcaaattttcctgcacgggttgaaaacaatccttangcatcttcaaatcatcccttacaattttaccctggttaattaatttggtaaactcgtcaccggatttgtcgagtgtcttaactttatcngcgatgctggttctgcacgcgtccaattttcggcgtgttttgtccaaatcttggt

SEQ ID NO: 971 - DNA, 135 bp, Ctenocephalides felis
ttttttttttttttttttttttgtgccttcagattttatttaaatatataacataaganaataaaaacattgatggcttatanaattccaatcttattancaatgtccaatgcatcgtaatccctggctaaacgt

SEQ ID NO: 972 - DNA, 498 bp, Ctenocephalides felis
tttagctgcatcntccccaacgntccaaaatactccccccantantaatccaacaagaatgtgacanagtacacgcaattgtgcaaagtnaaagtctcgtgacgtgcacaatagcgatcgttttgacaatactgcnaattgtttganaaatgatgtcggntacaaagattccgatcttgctttcataactttctttaagctgcaagagagaggctccgtttcgccaaattctattcgnattgcancantcaagagcnggatttttgccacgagcgattgatctgtatgtntgttattatcacatttcanactgttgattcctacttcggcgtgatttctactccatttantttctgtnanctctaccagangatcgaggntttcgcccgttncaaacttgcnangntctaangcacaatcggctctattacaaaantgtggnattgannggccgaatcntctatngttnaaatcangtcacaagtgngcctangtata

SEQ ID NO: 973 - DNA, 305 bp, Ctenocephalides felis
tgtctgcttctatatatttctccacaattaggacaatcaataacagatccagaccaagcatatgacattaaaccagcaacccacgaccctgcagcaagtggcccattattctgactagtatcagctgactgataatgcggtgttacaataacttccattccagacatatggcaggccttgcaaacataaactttattgccaaattgatgctgaaatctgcattttttactgttataatgcgattctccttgctgttcatggcccatgctctgtgcacatctttcgccacaagncaagcaaatggt

SEQ ID NO: 974 - DNA, 171 bp, Ctenocephalides felis
agaaaaaatgagccctgaccataagcaaagaccgaatcacttgagttttacctctgaacctgtaaatgtccataacaatagtcctactcatagcccaaaatcagcaactttatcgaatttaccgagacgaccgccagtagatgtggaatttatagatatttcatattcagt

SEQ ID NO: 975 - DNA, 498 bp, Ctenocephalides felis
tgaggtagaagaaatataataaatccaatacaggagatacgaatcttgctatttgccaatcgatgaagcaaatttcaacgggtttaccatcctgatatttaaacatcatattattattccaacaatctccatgtgaaagaactctataattttcagaacccgttgcattgaaacaactttccatatattcttcacaattatctttgattttcttcacattttcatgaaattctgtgatacctccgtcatctattgcttccaaggcttgtttcagtccaaaatcgcataaatcgtaaaaggcttctctaccggtcatatcatacatggctgagtcgatttgagtaattttatggaatttttcaggctgttgatctctcatgacaaaacttaatgcgtgatatttagctaatccttttgcaactaacgttatgtgagaaaaatccattttttttcttttgtcaaacattacaaaatttctggcgtgcaaatcttccaaaa

SEQ ID NO: 976 - DNA, 255 bp, Ctenocephalides felis
tgaagaagctaatcagcaagcaaagcaaaatgatatacaaaagaatcataataaaaatatctataaaggaggacattataaaaattatcaaagaggtggctatagaggacgtggaggacatcattccaggcgaatgcagaatcgaacaaatagtgatactactaacggggatagatgaagatggcttactcttttagtaaagtatatgtatcaatgtgaagcgataaagaaatatatcaagtcattataataagt

SEQ ID NO: 977 - DNA, 498 bp, Ctenocephalides felis
aagttttcgcagtttacaaatccagaagagataccagagcaacttcaacatcagatcaatgagtgcagttcacaattaagaatgtctagttcagagctaacaaagctgctatcgtcattatcaagcgtattgagcgatcaatcatatatccaacagcttctcgatatcaacgataccatcactgagatgtcagaagttgaaaattgaaagtcatcaacaaatgccatgtcatcaaagaatggcacgtcataaataattttattaaattctttttaaaatttatgtattattaaattgtaatgtctaatgcttcatattagtattaagttttcaaatttttatgttttttttttgtattgtattaatagtttacttatttttcttattttgatatacctggtaatttgtaacttataaagaagcttaagctcgtataaaactatctttatatttatcaatgcttatgtattttaaaacanaaataaaatgcttganagg

SEQ ID NO: 978 - DNA, 288 bp, Ctenocephalides felis
agaaacacacacacacacacatgctatatatattacaattataatagatgccccaaacccacatgcaattgactgttatttactaatagattttcatacttatttatttaacaaaacgctcttttccaattcctcctcatggttaatgtatcagcatgacattaaacatcaatggattttgaaatagtaaataattaatatttcagtcatttcataaataatcaacaggcaaactataaatcacacaaagggttgcgataatttaatagttttgcttgaatataatgt

SEQ ID NO: 979 - DNA, 498 bp, Ctenocephalides felis
atttatttttgcttaacaagaaactcatggacaaataaaattataggtaacatccggacgatataaaaataatttaaaaaatgtcactttctaacaatgttctagatttactaaaatattagttatgctttttatgtgctggattggcatgcaaaactctaccaaataaaaataagaaatttgaaaagaaacaattatttaaatttaatatatttaattaaattaaattacagggcagtaaatatctttcagcttatgttcttaattcaaaaactttattttcttttaattcaagatgtataatttgatgttgcctcttacaattctagtattctactaatatttttggattttgagttctctacatggtgcactactggtaacaacctggtgatactttaatggcaagtattaccttgataggatttccattaaaacattgtggcataagagtattgtttcactcatcctcagttgaattttcgacaaataaagttt

SEQ ID NO: 980 - DNA, 251 bp, Ctenocephalides felis
tttccgtaatgatgatggtgggcgcgacttccggaatgttcttgccggaaactttacaccaaaagttaccggaaacgctaactgaagctcacgtattcggcagggatcaggtgttctggagcttaccgaaaaaaggtgtatcaaagtctacagatacggccgtcaagaaattatcacaagaagactgttaaatagttataatttgtattgttatacatatgtttcttatataataaaattatatttattgt

SEQ ID NO: 981 - DNA, 351 bp, Ctenocephalides felis
tttttttttttttttttttttttgttgataaaacacaaatttattttacatgttaaaaattcttataaagtaaatacatcatccagttacacacgtatttatatatccatataactcgacaaagtagctttacacaatttggaaattgcaatgtgttaaaactaattgttttttagaactatattatattatattttggggaatattaaagttacggacctacaaaattaagactatgtaatgtattcttctttagccactgacaaatttaaataataaatcttgcttcgataagtaatttgaactaatatcgatgacttcctttcgtttttgaaaactaaaaactcttgt

SEQ ID NO: 982 - DNA, 224 bp, Ctenocephalides felis
aatgattttgtttgacaaatggtttttaaataaacaggtattcgaaattgatacgattgatgatgaagtagaaaaattctggaacagccatataataatagtccaaaatgtatttcatagtaaattacaaaaataattgattaaaattataaatctatgactgttcttgatatgaacctctttcataaaacatattaagatttgattcaaaattgaggtttaag

SEQ ID NO: 983 - DNA, 498 bp, Ctenocephalides felis
tacgagtgcacattaaacgctcgaggtgtattcgacgtggcccgatatgcttgtgcagctgagttatatttcaacagcgttctgcagcagtgcgtacctgcataccagtcagactgtttaggtgcaagtgtcacttcttccccatccataccatccttaccatccttaccatctttcccaaccttgccaacatcttccccaacagcaggatttccttttggccgaaaatctcttgatatgcaaacaaaaactggaactaaatgtacaaaaggagaagtttctaaagacgatttaaattctacatgtacctagtgagtgtgttatatgaaattgctattgcatattacatacaagcttaataaaggttatggtgatttatttcatttaaaggcaatgtatcggtttaatggttttaaatttatttttatttaatattaaatagattaattaaaaatctataaagtgataagaggctgatatccataatattattgaata

SEQ ID NO: 984 - DNA, 102 bp, Ctenocephalides felis
agaccaagtaaaaatctcactcacagcttttaccttattaggatcatttaaaaatctatctagaatgccaggttttgccagagattgctgcactttcttagt

SEQ ID NO: 985 - DNA, 204 bp, Ctenocephalides felis; identical to SEQ ID NO: 286

SEQ ID NO: 986 - DNA, 324 bp, Ctenocephalides felis
gcgccggacgcgtcaaataaactaaattanatttaatttactaacaaacatttggtcattagtttaatgtcaataatgtgcattttacatctaataatttgaaatcattaatggtcataaatcttcgaaaagttgatggcacttcatgcttcaaatcgccaacgacatancaagctcaagatgcaatattaaactatgttgtaaacatannatatattattgaaattttataaagaggacttttataatcgctcaaagtttgacttaatacaanataaattatttctcnttantatatttttatattttaaagaaaatgtntgt

SEQ ID NO: 987 - DNA, 498 bp, Ctenocephalides felis
gtgagttagcacacaaattagtctcagattcgatcccaacctctgtcgatcctatatcagacagcacgagaaaattttcacaaattttatagatctcaatttaatttcaagtgaaaatcgccttgatgccgataacaagctgcatataaaaatattaagttaaaacatattattagatataatcataatatgtcgcaactagtatagagcaactactgaataacattccagaaatccagaaacaagccatgcaataaaatttcaatacaattactgaatgtcctcataatatgaaaaaaaaatanannanatantataatatataatcgaagtaaatattcaattaacgaaataaaatcgtaacanagaatttgagagaataatttgcactatttatatggcgatatggcgttgtcantagtattcnctgtatagaatgatcaatctgataagaatgtcacatattaaattatttanttgaaaatttatatgaatccc

SEQ ID NO: 988 - DNA, 420 bp, Ctenocephalides felis
aatctgaatttcatgaattttggaaaaattagtcatcataatttcaaaatttgtctttgacaactttaaaggtagctaattctcacttcctattaacttgttttaggacaaaactccacttacacctagtttgaactacaaagactactatatatacaaattgaattttatgatttttgtataatttataaattcaaaattcaaaattttactctgccaacttcaaaagtagctgaatctcacttcctattaacatgtcttaggaagacaaaatttcacttacacctagtttgatcttacaactactatacataaaggctaaatttcatgaattttggaaaaaatgactctcatcattatttcaaaattttacttcgacaactttagaagcaattccacttactggtttgacctacaagt

SEQ ID NO: 989 - DNA, 500 bp, Ctenocephalides felis
ttttttttttttttttttttttttctggnccatacaactctaagctttccaacatttgtattttattcaaataaatataaataaaaatcataattcgacaattttacttgtatttatcttaaacatatttacagtatttcctcaaaaactgttaaatacaataagttaacttaaatacatggatgttctgagaatgtggatgagctcaagattgtagaactgagtttgatctacacaatttttgcctaaaaggttcgactactcagaaagcagccacccgtgattccataccgcctcacatttgacaataaaatatatgtataatgttaaataggattttaatggaaaaaagccaatttaatactttagcattatgaatatgtatttccaaattagtctataaccgaatttaacctaaaatacaggaaatacatattcatanatatacatatattttaatacaaaaaggtaacttgtgcaaaaatgaaattcaaatacac

SEQ ID NO: 990 - DNA, 498 bp, Ctenocephalides felis
tctttttcgatcattacgccagtagtatcttgcataattatgttaacaatattgttacattttataaaataatcttactattatctatagaacaatttataattttatatatatcaacattattgtttattgctagatattagaatttgtgtatttgataaatgaatgttggtttgtgtaaatgatatataattgcacgattttagctcacaaaagtttgcttagatatttgaactaaattatggacagatcgatacctagatccataacaaaaatttatttaaatttcaaatataatttttttttgctgcatgctgaataacatctcgcattatcttttgaaatcgtttctttgttgctaaatctttaaattctaaacacttttgtaaagatccatttccatcgaatgcattagtcatgtcttgaaaatctggagctgtttcagtattcgcggaaatgaaatttagagcaaaactacataaaactactccaaagtgt

SEQ ID NO: 991 - DNA, 498 bp, Ctenocephalides felis
tttgctcttcatagttcaggtctttataagaccagtatgcaaaatcagcttgtgcaactgcaaaatcaacatcctgtgaaaatactgccagagcgttattttcttttgcatatgttatgatttctgagtcacattcttcaaatgtggatctaataacattacatttattttggaagctacacattatgacctcaccgatgttacaagctggctttatattatattcattaacatattccaaaccattatcatctaaagtatcgaagatttcataaatagccatgatatcagacctttttcgagctacccatctatcctgcatatcatctatgttgcatccatcaaaaaatgcaactaattccacatcaaacctttgcaaaaattctatgaattcaccagctttttgcttatacaatttgtattgacctcctgtcaaaaattttttttggtcagtctctctaaatatttgtctagagcaacttccatcgatcactatga

SEQ ID NO: 992 - DNA, 498 bp, Ctenocephalides felis; identical to SEQ ID NO: 509

SEQ ID NO: 993 - DNA, 235 bp, Ctenocephalides felis
aattgatccataaattatgattaaaagattaagttacttaagggataacagcgtaattatttttaagagaacatatcgacaaaatagattgcgacctcgatgttggattaagataattttaaaatgcagaagttttaaaatttggtctgttcgaccattaattcttacatgatctgagttcaaaccggtttaagccaggttggtttctatccttaattttttaaaattaattagt

SEQ ID NO: 994 - DNA, 72 bp, Ctenocephalides felis
atcgatctttggcggctaaacatatcttgctgagcgaagccggccgtatagaaatatgtggctttaaggaaa

SEQ ID NO: 995 - DNA, 206 bp, Ctenocephalides felis
aacagacattagtcaccacgcgctcgacgaactttgattttttttccgaacgacaatcaagtaaactgcacataaaagaggagatgagatttaatttttgcgtttaatgtatgtaaatacttttaatcttaattaatttttgtcattcggaattaaagcagtcacttgatggtctattgcacggaccgtagtaaactgcgccgcgt

SEQ ID NO: 996 - DNA, 260 bp, Ctenocephalides felis
aatggtgtaaaaactgtaaatatcccatttgttgtcaccagccattattgatgatttaattacagttatgaaactgctgatgctatgagaattaaaattgaccaaattattgttttattttatttaaagataaatacatatatttaaatggaaattcgtggctctatgtccctaatgggacttctattatccataggaactgctacaggagtgatattcacgttagaaccagaggataggatttcattaaaaatgggcgt

SEQ ID NO: 997 - DNA, 310 bp, Ctenocephalides felis
ttcggccgtgttcttcatcctaagatgagctcgggccaaggatgcgcaatcgccttgggaaacgacgacctttaacgaactgtcgtccaagcgcatcacgctgaaactatgactgtcgtgggttgatggcgaactcattgttgaaccttacaaaaactcttaacttaacaataaatactgttcattaaaatcaataaattatattaaaactaaaagcgatcgaaaaaactatttttttttaatttggtaaaacaatcttaaaagattgtttagaccccggaagaaacagtggtttgttactgttgtcaca

SEQ ID NO: 998 - DNA, 59 bp, Ctenocephalides felis
tcctggatgagcgttttgaaattctgtcattttacttatgatatcgggaaaccacatgt

SEQ ID NO: 999 - DNA, 498 bp, Ctenocephalides felis
ttgaaactattcattttaaaataactgtgacaatctcatattatattattcacatatttgtatgctaatatagatcttatatattatattcatttttacaangatgcttctttagaaacagattttttttcaaacagattttttaattgtctttgaacatttttcaaattttcttctttaattgtaacaggtagtccacattctttctgatccttcatgatttgttccataatanaaatttttctttttagaaagccttcttgctctgcttttaataagttttcataggctgccaatcttttagctttcaactcatcacaatatatattagttagtttttgcaatgattctttcctcgttatccagtgaaaatgatttggtggtggnttatatacaatattcaanttttcnaatatcnactcanatcttttgtagtcccatctcctaangtatttcaaaaatttcttacgttatcaatnaantctttangtaaagccg

SEQ ID NO: 1000 - DNA, 231 bp, Ctenocephalides felis
gcaatcatgcaacaataataaagtatctatataatatcttacaaattgtacaaagttaatcatgaactaaatgtaatcctactaatataaatacaaaacttgtataaaatgttcgaattagaattttggtaaagtgaaataaattctctataaaactaaaaaaaatatttttgcactgtatcatatattccattgactcagaactcaaagactataattgccgaatcacgt

SEQ ID NO: 1001 - DNA, 247 bp, Ctenocephalides felis; identical to SEQ ID NO: 233

SEQ ID NO: 1002 - DNA, 297 bp, Ctenocephalides felis
cacctatgtataattttatatatatatatataaagaaaattaaatctcactcgattttaaagataataaaataaaataaagttacatttataataatgtaagattaaattgtaaattctaatttaattatatttcaaattaaatatgttaatgtcgaactttaaatgcaatttcatttatattgcacgatttattttgtaggtcttgagtaaggggagctacgataacgcgtatcgcgggtgctcacgtgacggctagttagagacggttcctcaacacggcccttagaggagctgt

SEQ ID NO: 1003 - DNA, 498 bp, Ctenocephalides felis
acgcgttgattaattttgcgaggcagcaggccaagccatttctttttaattagtagctaattagacaaaaggttttgtcaaaaatcctgagccgatttcgaaaattttcaactttttcaaaaatatctgtttggtattgcttccccgtagttacttgttaaaataaattaaaatagtttgacaattttgtagaaaaaatatttcagatttgtaaaaaatattttaataaagtattgaatggtcgtggacgatgacaaattttcaaacttttatgttcacaattttaaaatttgctgcatctcaattcttgtagattaaatacacatatctgaaagtttttgcaacttgtcttaagccactaaaatgccacttacacctagttaatataagccaaacccaatttgtaaataagtatacagaaaaacattccaaattttatagataatacataatctcagattatttaagtggtttagaatggttgccaggnagaactaa

SEQ ID NO: 1004 - DNA, 498 bp, Ctenocephalides felis
tcgttgatttagagttattgtattacattacaataaattttaatttttagataaattgacgtctttttacatatgtttggaaaatatctgtattagaattttaattacatactatcacaaattaataaggtgtatataaatatacagagaaactataatttgtttaaattttatttcgtgtcgcttcgtttcaacaaacaagcaaatttccatgaacaatttattggcaacatttatacaaatagctaaaatttattctatttttgaatatcatgaatatttaaaacttaaattattttattataacgatatacaattattaactttttttatatacctttacgtttcaaatgtttttgaatattttggcataccttaaaaaaattgatgtatgtgtgtgagtggatgcggatacaaattttcgggaacaccgatcaaccgatttaaataaatcaaaatacattcgaatagtattaggcaggtctagtcgttccaaaa

SEQ ID NO: 1005 - DNA, 498 bp, Ctenocephalides felis
aaatctcgatagttacgcgactcataaataattatttaaacaatgaatgttaaaaaaaattaaagtttgtaaatataatatatgtattggattaacttagttaattctccctcgcaattttatactatagtaaccagaaacaaaaatcagagtgtgtaaaatgtaaattcatatatttttggtaaaaatacaatcaagatataacagtgccacaatattattaaaatacgtatttgtgacgaaacctaaagtgtagtcagaatataaaaaacaataatatttataccttcaaatgtatgctttgaaaaaaagcattcgaagattttgtttaaatattttgttaagtccacatttatgtttgttcgttcaattaaattatgtttcttttgcaagtaagattatgttgtagatattgtcacaaaattagtatattttatgtaattttaagcatattgntattttttggaaaatcggactattgtcaccaaaattaaataa

SEQ ID NO: 1006 - DNA, 67 bp, Ctenocephalides felis
tattcgtagtatcaatgaagtcgtccgccctaagcattgatgaattttggacaacgtagcatattgt

SEQ ID NO: 1007 - DNA, 498 bp, Ctenocephalides felis
catttgatttgattatattcttgagtttatttacttcatcataacagcaacataaaggatattccaaaaaatatgtgcgaatgaatttgatagttttcatcacctgtggatgtccaatatcgttttttaaatttttctcacatagtgtagtaagtcctttaagaaagtcattcgacaacgttttggattttaattccaataacagataattctctggatagttactcggaaattgtatgcacaaaataattgtattaaatgatgtcgtgctaatttctacacgaaccatttctccgacacaagtaataagctttgtattatccaaagttttctcacatagttgtcgaactgttttaagttcatcgtctaatgcagccatacttcgttttctctgtataatgtgttatataattatacagcaacaaatgcagctgtttagaaatttttagtgaatatgagtatgatatattctttagaacatgtaagctaattagatta

SEQ ID NO: 1008 - DNA, 95 bp, Ctenocephalides felis; identical to SEQ ID NO: 917

SEQ ID NO: 1009 - DNA, 406 bp, Ctenocephalides felis
gtttgctatattagttcggcggtaagaaatatttttttaatagcttgatgaaaacaagaaaatatttaatcgagtgattttaaatataaaaatatatatatagaattatatgacaacaaaaaatgagtaatgtagacgtcgtcgtgttttcgtttcttgtcattttatttaacatttcttacgcttattacatattgttgtatatacatacatatatataaattaatagaagttttatcgaaacgatattgatgaaatgtgtcttgtaaggttttttttaattacgaaaaaaacaaaaaatgtgtgaaactgtgattcctgcctttctcgtgtaaaacggcgatgctagaaaatagaaacattaagcgttctttccatttaattaaaaataattactaaaaagctg

SEQ ID NO: 1010 - DNA, 84 bp, Ctenocephalides felis
taattaattttaaaaaattaaggatagaaaccaacctggcttaaaccggtttgaactcagatcatgtaagaattaatggtcgaa

SEQ ID NO: 1011 - DNA, 228 bp, Ctenocephalides felis; identical to SEQ ID NO: 560

SEQ ID NO: 1012 - DNA, 245 bp, Ctenocephalides felis
gggtggatcattccaacctggtggtggtgtagggtttgctctacttggcatttgagtaggaggtggtgcttgcggttggaattgattgacaaaacctgctccttgtggtgaattcaacatagggttaagtagggcatttgttggttgaggttgagaactaataggattcagaagacttgctggttgttggaattgaccagacattgtgctcatcgtaactgtattggcatttacaggcgaattgt

SEQ ID NO: 1013 - DNA, 351 bp, Ctenocephalides felis
atggaataaataatgttggcccatatatatccaatttattattaaaataaattcatgatccacggcagaccttaaatttaatttgaggtcatttaaaacatttaaaatttattcgattaacaacaatttttagtagtaggttagtttaattatgaatcacaatatagaattagcacatgtatttttgtgagtatgaactcacaccaataaacctgaattttaataatgtttaaggatataactaggtttatgattacattgctacagcaatcatttgcgggcagtttggaattgtgcatggttcagcactcttgtatttgttgcctcttgttctagcttcataatgatcgt

SEQ ID NO: 1014 - DNA, 496 bp, Ctenocephalides felis
agcactgccagaaacctgtggctcatattcaacagccccgcaagtagatacaggtctttttaacaagtctcaagttataattcattgttgttattgcaataaactttacctttgatctctttccaattatctataaaaattcattccaaaattactgcaattatttagagtcacagattaataatcttaaaaggtttcgagttagtgtgttacattaagattttctcatgcttgacagaatcttagtttttctttggttgttttataatttagaaaaaaggtgaaggtgtgatttgagagattgtaaatgcttggcactattctatgagatgtataaaatatatttttaatattttaatgatttatatttaaataaagtgttacatttaataataatgtatataattgcaatacgtttgattacattttttagttttccatatgtaactttatatttgaatatttaatacattgcaattaaaaaaaaaaaaaaaaa

SEQ ID NO: 1015 - DNA, 194 bp, Ctenocephalides felis
atcctttttttctatgaacggttttaggtaacggagaataatgtaaggcatcactaaagtcgtttttatttgtgatttcatgattaggctcgggtcttctgacccgcataaattgaccccgcaattttgcttcctttgcctcgtttgatgatacagcccgccaatccaaaaataataattttggtaaatgatgt

SEQ ID NO: 1016 - DNA, 401 bp, Ctenocephalides felis
tatcatcaacagcaacactgtgaaccttttttcttctcacgacaccgtttatcgcggcatcattggtcatatccctatcaatagatgtcgaatctaatggcaggtgagtaggtctgggaggagcagacatagacctttccaaaagttcttctgtcggttcaacgttcattttcattaaatccctcatccgtggaggttttactggaggcgtgctattaccttctgaaggtattgtctcataaatggcttccgatgatgcacttgatgccactgtttttgacaataattcattgtcattaatgactgcaggttccttttgggcagctatatatgactcagggcgtattcgatgtgatcgcctcgattctgtcgtcgtctgagattcagctgaatgggaacgt

SEQ ID NO: 1017 - DNA, 422 bp, Ctenocephalides felis
tactgatttcaaaaacaaaatcnaanagaaatatactatgaagttcaactgtaatgggacttagngcaaataaatgcgagggagtgagagaaagagaaagagaaagagagagtttgaataaattatattaactattgcnagaaaaaaagantttaaaacaattatgttaactaatgacaatatatgntccattcatcanatccgaaagactgcacaanatacttattctgnaaagatggtaaaggtnaggttttcgaatgcccacctaactatgtatatgatcattctaaaaatatgtgtaaaaagaaatcagtcagaagntgattgcaccgtnatgaaatgcacaaatcccaattctttataacctatgcaccgganccatcaatntatgctttgggcaatgacaaattgcaaccgatcgt

SEQ ID NO: 1018 - DNA, 233 bp, Ctenocephalides felis
taattaattttaaaaaattaaggatagaaaccaacctggcttaaaccggtttgaactcagatcatgtaagaattaatggtcgaacagaccaaattttaaaacttctgcattttaaaattatcttaatccaacatcgaggtcgcaatctattttgtcgatatgttctcttaaaaataattacgctgttatcccttaagtaacttaatcttttaatcataatttatggatcaatt

SEQ ID NO: 1019 - DNA, 459 bp, Ctenocephalides felis
cctaaaaagcggatttggataaaatttgctggttgtatgggagctgcctattcatcctcgaggaaaaatagaattagcttggattctcacacgtgagcaaaacccatcgtcggaattaatgaaagaaatttggacatatgtgaaaaataatacacccatagatgttgacaaactaaaacacaccgagcaaaattgtggaaaggatttctgaagataattactggatataaagnccttttaagatcagctttatcaaaacaactgatgtttaagaataactaaatatattatacttaatacttagcttttcctggcaatactatattaaaatattgacataagtgcattaatatttttgcaatagatttgctttttatattcaatatataatatgnattaataataaaatcttctaacatcaagtgtataaatgcattaattttctcaaaaaggcttatg

SEQ ID NO: 1020 - DNA, 477 bp, Ctenocephalides felis
cttgaatttgataagtgaagcaattagaataaagtccgaacttttgcttagatttagagatgcattgatgagaccagccttgtctaaagcaaagctttccttggaacgacttgaaaaggctgtttcaatggctattgatgatgctagacttaaatttgaaaatgccatccaagaaatgaatgacgacgcagtaggcattcttaattccatcactgaaaaaatccaagaggaaaccgaggagatcaaaacaaatattggaggattactattacaacaaatgttcgatgattctgcccgtcaatgcttgagggatcaattggctgcagttaaagttttggccaattcaacaatcaacgatgcaaattcatgtattcgtcgtcaattatttggagctaatgatttaagtgataatcttggtgcaatatttgatgaagctttcgaaggtgttcaagaattagttgatgagctaaatgattg

SEQ ID NO: 1021 - DNA, 433 bp, Ctenocephalides felis
ccatgttggtaagatttattattttatatcccttncaaaaatctgcacgttgttcacaaaaaaaaatcataaaatcttaaatttatttgcaaaaaaaaaaatagtgcgggaggagtgaaacttcgtaaataaaactgcaaaagttacattgataatttacaataaattcagacagtttgcaacgtttctagaaaagttcagaagttttgaaacaaatttcatcattttcaaccaaatgctttcttttctatttacctttaaagnttcacttcaatatctccctataatattttgntacaagagtgttgntttaagatttatagcatattacaaactgntagttatattattttctacttatcggtaatgnttcctttttttggtaatcagtttacaaaactttctgcaaaaagttgtgccatcaacaatttgn

SEQ ID NO: 1022 - DNA, 319 bp, Ctenocephalides felis
atttatttgttgaatattttatatcaatttatttttgataattattttgataagctcaatttgttctttgtgacaataatttaggcatataaaagaaaaccagtaaaacaatacaataaaatcaccaacaattagtttgtttttcttctgtgttattaatcatcagaacataaataaattctataagttattttgatatacattattgactattagatacaatttattgaatcaagttaattggtcgtaattttttactatttttatatttgtaaataataaattaagatcttgcttttagaagtcttcaatgtatagt

SEQ ID NO: 1023 - DNA, 518 bp, Ctenocephalides felis; identical to SEQ ID NO: 513

SEQ ID NO: 1024 - DNA, 112 bp, Ctenocephalides felis; identical to SEQ ID NO: 236

SEQ ID NO: 1025 - DNA, 304 bp, Ctenocephalides felis
atatctagccaatattgcaaaattcttatcagtgcatgtgaaagaaaaactattattntcgaaaatatatcaatattattataagtaaagaaattgtcattccgaatgaacttctgaggtctaaagacccattacacaagtcagtgtcgcacatggtgcaatttagatcccgggctcctttatttgttaaatctttctttatttcttcacatgtgactcgggcagggacacattctctaatcacacctttttcaatcatggatttatagaaaactctttctccgatgtctgttgtacactagcg

SEQ ID NO: 1026 - DNA, 498 bp, Ctenocephalides felis
ccggtatgaaaaggaaagtgcttttacgtccaaaccgtggagtttccaatatgccacatgtcattattcgtttactattcttatccttaatatttatagcactgtcgtaataattctttgtaaaatgagccatatctctgttgagagtcataccgtaatcatatcgacattgatatgattctccacataaatcttcagcacgattgatgtcgctacttctgtttgatggaagaaaatctttaggttctttaacccagtttggtataaatgaggaatttgcataataactggctgtncgaccaaattcacgagtgaagagtgccgctccgaggtgttcattttcacgatccgcagcatccagtgacgtgcganatctttatgaacagattcaaaactattgagattaacaggcacaaaagttccatcanggtngacaanagcgantgccatatcccaactccaatttccgagtagaccagcagtttattaataaatgcc

SEQ ID NO: 1027 - DNA, 305 bp, Ctenocephalides felis
ggaatattaatgcattatcgtttcggtgctaatatattcttatatatgtattaaatttgccccgttttcttaatctgacaataagagataataatgtcaacaaaaacatgcgattttaatcttgacataaaaagtgctaaggtaatgtaaataaaccgtaggcagctgattataagacaacttttatataattactaaacaatttttatggcataaattaatttaattaattaaaaaatataattaataaaattgataccattctaatcaatataaaattatcattttatttattcaaatcnaag

SEQ ID NO: 1028 - DNA, 127 bp, Ctenocephalides felis
aaaggcactttttgtcttcaagcacacacgaggctttaaactaccaatgtaatatttgactagaataattttaattgtttcagcgtccactgaaggctttaagcaacttcgtgccaaacagactctc

SEQ ID NO: 1029 - DNA, 498 bp, Ctenocephalides felis
aaaattccaaattttagtttataaatcatcttatatggaaactgtctgcaacaaaccagattttaaaatagaatccaataaatacggatataaaattttattaaaatacacaaacataacaaatgtcgttaattactaattcaaagtttcatacgatatgtcatatgctaattttagatttattatcataaataaatttattatttaaatcatattagaggaaaaaaaaatattttctcaattctctccttcaaaacttctttgcacttctccggctccatacagttttaataccacttttttcacaaaattcaacatttttgtaaaatccattgtgaaaattcatttggctgtttattaaaagacatcatcccttcggaatctgttatataccccaaaccagcactcttcaaatacacaaaatcctttttcaagttaacctcgaacgttacccatatttggaagttccttttggattcaacattgaatttgttttcg

SEQ ID NO: 1030 - DNA, 454 bp, Ctenocephalides felis
acaagtantaattgtttatacaatatgatacatagttgaaaatagcatgaaatatcattataattttgaaaggataaattctgttgacatttttctttttttttaatatttttcatatatatttgatttttgctgaacattataaaattcatgaattatagggaaatagaatttgtaaatttaaccaaacttaccaataagtcaacattatatgataaggaaatagtaaatatgacttcttaaaatatcagttattaaaatttggagcaatatgcattatcaataaatttactggaatttttatgcctgaaatcaaaatgccagaataggctgtgaatgntttaaatactttttgatagttggatatggaatagctgatttgtgaatgattctactgatgnatatttactaatactaatataaaacacgaananannngnanaaaaaaagcttg

SEQ ID NO: 1031 - DNA, 154 bp, Ctenocephalides felis
tgatagatgtattgcaataagttatttttttatgaaagataatgttcaacactaattgaaatagattataagattttcactacattttcatcccattttttctacatcatgaaattctgtattgtatgtaattcattatttttaagttaaatgt

SEQ ID NO: 1032 - DNA, 285 bp, Ctenocephalides felis
atatttatattattatgatatatattgttaaattataacaatatgattatttacatacatattttattatttatcttctaggaactctttatccatattattgaatttttctactaaatctgaaggtatttctagagattttaggtcatctgtcccaatttcttcctcagttcttattagaatgtcgacaacattctcacaagcaagcaaactggccttgtcaccaagttttaatgaaacttgttttgtttcccatttgtggtattctcttaatatttcataagt

SEQ ID NO: 1033 - DNA, 498 bp, Ctenocephalides felis
atcgaaaacaaattcaatgttgaatccaaaaggaacttccaaatatgggtaacgttcgaggttaacttgaaaaaggattttgtgtatttgaagagtgctggtttggggtatataacagattccgaagggatgatgtcttttaataaacagccaaatgaattttcacaatggattttacaaaaatgttgaattttgtgaaaaaagtggtattaaaactgtatggagccggagaagtgcaaagaagttttgaaggagagaattgagaaaatatttttttttcctctaatatgatttaaataataaatttatttatgataataaatctaaaattagcatatgacatatcgtatgaaactttgaattagtaattaacgacatttgttatgtttgtgtattttaataaaattttatatccgtatttattggattctattttaaaatctggtttgttgcagacagtttccatataagatgatttataaactaaaatttggaatt

SEQ ID NO: 1034 - DNA, 88 bp, Ctenocephalides felis
acaggatacaagtgttctgtctgcccataataaaaaacgacataaacgtagtaaatacgataagtaatatgggcatcatntatcagcg

SEQ ID NO: 1035 - DNA, 394 bp, Ctenocephalides felis
ttagcccaagtttcacagcaggtttggcagtcactataatagtatgctccctttcattttcccctgaaccaactttgnatgtgtaagagccagcatcatcttgttcagttttttcaataatgaattgatgttcttcctttattaattgataacggtccttgagatcattgatttcttctacttttttctcatctttaaaccactgatcaacaggaccatctttcaatggacaggttagaaccaatggactgcgaatatcaaaaagtttttgcgacgtggcttcaccttctcgggcataaacactgctttgggccaataataataaaattgcactacacaaaaactgcttcatatttattgaattttcttcccctcgattgaaaaagttcataag

SEQ ID NO: 1036 - DNA, 498 bp, Ctenocephalides felis
taggaaaaattatacttgataacacttcaaattcactcaaaaatataaaagattttatttaacgatgttactctggtgaacgaggctttttttgaaataatatacatacactaagtatcgagaactgttgcataaaactcaaaataattactgaagcattaaaaaattttgtcgccttcaaaatagaccttattcgaagtaatgaaaacatgccaacaattaatccaatcttcaaagcatcttttaaacgcctttataaggatattcttcagctcctttggcgtttttttcttacaaacattgttagtggaatctatcgatccaaagaggtatctaacaatagtattacttgnaattctatacttaagtatccatgacaataaataatttacagagggatagatctagtgaatacgttggttgcccatgatatttcatgagtttatggccnnaaaagcgttcacaatataggcgttgtgtgaagagagtcaacaatga

SEQ ID NO: 1037 - DNA, 415 bp, Ctenocephalides felis
ccacatgaaattttaaatggaaagtatgaaatcagtcgcattcaagtatttaacaacatgctatgatagnnttattaaaacaaccaaatttaccatgtagcaagtcttcgcaaatcatcacattttttttcaacaatggattttcagtgacacttagaacaagtggaacagaaccaaagttaaaatattatagtgaaatgtgtgcaaaaccagagatgaaggatctagtcacactgaagcaaactgttaaagaaatgatagaagctgtttgtcaagaatttcttcaacctgaggagaatagattaatatcaagagaaaaatagatcttaattaaatagactttaaataattagcacaatttatttttagctgaagagatttcagttttcacttagctgaaataaaacaactattg

SEQ ID NO: 1038 - DNA, 109 bp, Ctenocephalides felis
aagctggcttgccaccgtttggtcctccaccatttgaagcaaatgttggaaatagaacagtaacattcgttgaaatgtgcagcgacctaggatctgccatcatagttgt

SEQ ID NO: 1039 - DNA, 440 bp, Ctenocephalides felis
gggnaagtagcgtgtgttgcncttctgaaatnantnggaaaccctcggaacttntnggggnantngccnaggacatnctatgcaaaataaattagtaaaacaatataattnaantatttgcaatctttgctgtgtataaaactangggnttatnggntgaaactgatttaaattcatttttgaactttgttcttatatgttgntcgtcattagctaggaatgttcctacatatactttaacattcacctaaatatatatatatgtaatcttatatgtatataaagtttttgatctgtgttggcgaggtaatattggcttgataaacagtgtttttaacatgatgaatgttcaattgttaaatcttgtgaaaatgtaaatttgcaatttcagctgtgaatgttttctggctgcctagcatgtgtattgcatcatatggngt

SEQ ID NO: 1040 - DNA, 500 bp, Ctenocephalides felis
ttttttttttttttttttttttttttttataaacaatttttatttgtcaaaaagctacataagctagaaccattngaccacaaataatatatcactagacatttttaggaagtttacagtttgttatacaattcttaaactaatttagttatcagtaagttttaagcagtcggcacagtctttacggacttgtactaagttgnccctaaattctttcaaggctccccttgcgcattttccgacttcacggactaagttgcccaattgggaccaggtttctttgagtgccttggccaagtcttttgctccttcgtgggcagcttggagaacccctttcaagcaaactctggcttcatcgacatcggctgcggcacaacgcactccttggcttgngctctgagggcttcggcgtctccctggcttntnttcagcggccaaccattttggcgaacttgggtgaattcatcacgtttggcatctntgnaaccttgaccttacac

SEQ ID NO: 1041 - DNA, 498 bp, Ctenocephalides felis
attagatatggtctgaccatgattgatatattttgatacattttaggcttataatatannaaaatacagtcaatttaacatttgatattacatatattaaatcaacaatatctaaacattgaaattagagaaactgaacctgaagatagtgatttaagtataaattctaagctagtaaagaagatccgaaaaaatctgataatggtaattttaccgctccaactaaatatccaaaattccagcagaatttgtaatgtaaatattgattctgataaactgaaatcaccagtaaaaaaaatccaagaagttctaataatggtaattttaccactaaggaatataaatgctgctgcaagagaagatttgactaatttcaaacagaataccccatcgaaataagcgatcagcaattgaagaagataattgtgctaattggtgatggtcttaattttatgatcgtttatatatggtaataataagtcttataagcttttgatt

SEQ ID NO: 1042 - DNA, 498 bp, Ctenocephalides felis
gattgctttgaaaaaagttcagaatttccaaaatatgtcaaaataaaaaaacatttttttttcaaaagnggtattttcttgtcaaaatagtttctcaaaaatgttaatcgtttttttaaaaaataataatttttattacgggaagttccagcaatttgccttaagacacgatgccatgcgcccactagttataaaattgattttagataatgactttcaatacgtcgcaggaacatttagatgcggaatgcgttgcagtggttaaatcatccatataatttgtattagctacctaattgacttataccccaaatacctccacattttcagttatttttaactttctgtagggtaaattatagtaattgtccaaaaatcgaaaataaaaatggttgcatatcttcacgctttggcataccttagaaagaatggatttatgtgtgtgtatgtagtatgtatgtatgtatagagacaatttttccccgacgttttcgggag

SEQ ID NO: 1043 - DNA, 498 bp, Ctenocephalides felis
aacattgttgtaaataatatgttctcgatccaatatacaatactgtagtaaataatatgtgctcgaatttaaagaaatgtccgggctcgtgtaaactacatatatgatgaataatataatcatcaaatactattgggtataaacaatatgcattgaatggtccagagtataaataataactactttacgcccccgggtgggctcgaaccactaacctttcggttaacagccgaaagtgctagccaattgcgccacgggggctcttatcgcttcttgataatagtaacacatctcaataaacacattttacacatgatttgccattttagtaaataataggcactcgattttatagaaatgtcagggctcgtcccgggatttgaacccgaaacctccgcacccaaagcgggaatcatacccctagaccaacgaaacacatgttctatccagtgcgtgttggggtgcatccaatgtcaacattgtagtaataatatggcc

SEQ ID NO: 1044 - DNA, 437 bp, Ctenocephalides felis
gattttcaatacaaagtggaagatccgccaattcaactttcatttggtgccaatgaagcaggagatgcatcaggaaaggtgaccggcagctactacgttttactccccgatggaagagtgatgactgtcgactacgttgtagatggcgaaagcggttttcaaccgaaaatttctttcaacaaatagatcaagctgacaaaggaatcgaatcacgtaaacttcattaacaacatcatttcatagctaaaaatttaaacaacgaaacatatatactcatgaattactgcctatattattgtttatactgcctaataaacaatttgtgattaatactaattaatttactactgctaaacagaagaaatatatgacgaagctgtgaaacgcaataaagttttgtaaatattttgcagattcatttaaactaacaattatgt

SEQ ID NO: 1045 - DNA, 498 bp, Ctenocephalides felis
taattaattttaaaaaattaaggatagaaaccaacctggcttaaaccggtttgaactcaggatcatgtacgcaattaatggtcgaacagaccaaantttaaaacttctgcattttaaaattatcttaatccaacatngaggtcgcaatctattntgncgatatgttctnttaaaaatanttacgctgttatcccttaagnaacttaatcttttaatcataatttatggatcaantattcaattatttatgttttaataaaaaaaangttttataaattntcctatcaccccaataaaatgtattaatataaataaantntaataatattcttaaaattaatctatattnatatataaaactttataagggtcttctcgcctttaataatatttacgctntttaacataaaaattanattctataacaattntattaagacagttaatatttcattcaatcattcattccagctntcanttaaaaaactattgatatgc

SEQ ID NO: 1046 - DNA, 582 bp, Ctenocephalides felis
cctacacaactcganatactcataaattattaanttctaatcgattncctgaaaaagggcgttgggattggtgaaagtgcatttattcgttacatttctgataacttaaaaactatttgcggaaaactaaaaatatgtttggagaaaatatagaaaattgaatagtctaaaacattttcctaacataggaagaccctacagcaactcggnatactcaaaaaagtttgttgaaaagttgataaatattcacagcgcttcactgntttgttcttgagtttaggaaaagtgcatttatttataacttttgaacgggttatttgattggaatgaaatattcggcaaatttatagaaaattaaataatctacaaanttttcttttaccgcaacagaaaccaacgaaatattcccttcggctaatacgggtaaacatcacaaaatgnatcgaatcaatatttttttaaaattgaaaattgcaaatgataaatggaattggatttatatttttttctaaaaangaatggggaactattccaaggaatgggagaatgnaagaaaaataatattattcgatgngaaaatgg

SEQ ID NO: 1047 - DNA, 472 bp, Ctenocephalides felis
cccggnttgggtgatcaacaccaaagacacgctcagaattggcgttccattaggtaattccaggttcacgagagtcaaatcatcaaaggggtagcgttctttaaagcgtttatccaaagagtcccaagtattatccaattcctcatccacaaccaaaggatatgtattcttcgaatccaaactaagtttatcagtgccttctacaactacagtgactacagctttaggtaattgaaaaggattcaatttactcactccgtcccattcagcagaactctgctccgatgtcaatcctaaggctacggaatacaattcctttaacaaagattggggtaaaggagtctcgccttggaattggactccatttggagaatttaatacactcagttcgccgttgcaatatatggatgccacaaggggcagtaaataaattagaaccttttgcacattttattacttacggataaaacgt

SEQ ID NO: 1048 - DNA, 221 bp, Ctenocephalides felis
aagcagaagatgagattaatctgcggaggttgttgacaaattaccagaagatctggncggaaaattgaacatttcagcacttccttcgacagaggaagcagaaaaactggccagagaaaaatgcagaaaggaaagtggaagcgacgatgcttacgataaagcttttgccgccaaagatgagctgaagacttgtttcacgtctttgctgaatatggaggaac

SEQ ID NO: 1049 - DNA, 427 bp, Ctenocephalides felis
ccaataattacatttaattgaaagtgtcattaaaatattgaccatgcattatacaaattatatttataattatngcgttaacaaaataaaataattttgtgctaaagcctctgcaataaaaagaactgactcatatgtataaagatttaattgtataaatgcaatacaaattaattacagttaaaatttaagaacatattgcatgacagtttgttataaagcataaatgactgcttagtttttttttttaatgaaagtttaagacatctattataggaagatatatggcggaaacagaatcattacatatacatcaacatcaatgtgcattacttttttttttaatttctcttcagatagaatacgatgaatataaacataagtatgaattataaaattgtattgtatactgtataaaattaaatgt

SEQ ID NO: 1050 - DNA, 570 bp, Ctenocephalides felis
aaatacaaggggttgtatgaaaccaactgatgactgtgatgatatgaaatgccaggagtgcaaaggtaacctttgtaatgtcgatgttttcccaagaaatcgcagggtttgcaacgctaaagatgatgccaaggaagtttgtctcaagccacaagatacttgtttgagtattttaaatgcacaaggtgatgccataaaattagggtgcaccagcaacctgttcaagaaccagaatctgaaaaaaatgtgcgagaaaaaaccagaacgttgcccaacttgtgacaaaaacgaatgcaatggtgatgccaaaaaacacgaatgtgtttcttgtgatgaaaatgatgaaaattgccttgacgaccctgaaaaagtcgagacgaagaccaaatgcatgggcaaatgctacttagatattgacggagataaagtgaagagaggctgcaccgacacctacaaatgcgataaggaaacttgtctggaatgcgaggaagagatttgcacgagcgaaatgtgctatgcgtaaattgtttaaataatttttgcaagttttaaataaaatttatcaacttn

SEQ ID NO: 1051 - DNA, 386 bp, Ctenocephalides felis
atagatgnacannctnactnncgaaaaccccgncgncggggcagaggcgcgntcaagcatanggtctttggtatttcgttatggcggcgaaaatatatcgataatatatngggattggggtataggaantganttaatattttattggaaacaaaagtttaaaatagttttgcttaactattatttattaaataattattatgcatcattttaaaatcagtcatcattcatcataaatatcgatattcgtatttcaatatatcgcacacctcaattaatttatgtatcaattatattgattganttatttgcgaatttctcagttatgaaaatgcagcaatgcctgtgatagctcttcctagaataagtgcgtggatatcatgtgt

SEQ ID NO: 1052 - DNA, 537 bp, Ctenocephalides felis
cctctctcagggtaaagtgatatgagctgatttggtttcatttatgcaaatcttccatttggcaagccacatttgtagtttattgatatgttcttgcgtttgtcgggaagcttgatcagcactgtgattatttttaaaggtttaacttatcgaaatacggaaaagtcaaaattcgattttctgaaaatttcacactaggtgggcttcttaatataaggttgtagtgaccgaggtcgctaacgcgcggacctatgtggatggtgtcaagttggacggacctgtccaagggcagtagtgctacacattgnatatatgtattattttgtattaattttattcaattacaatttaaaacaagctgtttgaaatgaaacctttgcttccatattgtttactccagaatctaaaattatgaataaatgaatattctagtgaattatttgtaaaagttcttcttcaacttagtatctaaaatacaacaaacaaactgcgcataaatcgagaatattattagacatcatgcagagtccctgccgg

SEQ ID NO: 1053 - DNA, 331 bp, Ctenocephalides felis
ggtctgaaacactttcaaacaaactcagaattatcgatgatattttggaaatgcaaaaaatggctgatgagctaatattattggcacctcttaaatcagtcgtaaccattgaaacacttcgcaaaatgtcaaaaaaaggattgacttatgagatacttaaaaaagcttacgaaggaaagggagaagagggccttgaacaaattttgaaaactaaagtaacaaaggcaaagcttactataaacaatgttgtggtgttttttcaaaaacatgcaaatgatgtttaatgacccttatttatcagaaatatattataaatatttaacattttagt

SEQ ID NO: 1054 - DNA, 344 bp, Ctenocephalides felis
cagngattcatttcatattggtatacatatttctcaatatgncatttttctaaactttgtgggacagnaatataccaagttccttccgtaattgntcatctccaatatttccattatgaggaatgcttctaagcatttttaaataactgnctggnaatccagattctaacgctccttgaataattgnctcaaganatatcaaactaggcttcctatcttctggaaaaggntcacccggttgcaacggagcaggcagtttactttgctcatatattcggcacgatacattttcgccactcttagttttgatgnttacatctttagcaaagtatgtgtttaaatgt

SEQ ID NO: 1055 - DNA, 264 bp, Ctenocephalides felis
cccatattgaacatttatttttagcgactacattagaaatgtaatagataaaaatgttataaatctgcgaatataaaatattgtattttcataaagaatattattattctttcttattttttgttcatagcagaatatttttttcgccccaaaaagccgacataatacaccactaaagacttgtcgaaagttgtggcgtccgggactcgcaaattcaatttgtgcacaatcgcgcggtgaaatgcacaatttccatttctatgt

SEQ ID NO: 1056 - DNA, 647 bp, Ctenocephalides felis
tatacatatttcagtgaganatcagcaatagtttatgattttattgacgttgtgaacggacatgtgntctgggngtttataaatttgcgtatagaaacaataataaattacagtacataatactgatttgattttactaccgnaacgatttgcttcagatatttccagaaaaatgttagttttcatacattttatttaatttaatatctccgacttgttattactaagcgaaattttctctcttttaaatatagaattctttatagtattcataatagtgaagctttaaagtatttctctcactatcacccttttttatacaaacgcattttgagaagtaacgtgaaagcttactttcgaattggtgatgnttctatgaatacttatatgtattataatatgnattaaattgaatttttgcgtttcaatagaacttcaatcataaatttgaattggggttaatattggtgggggttggattattaaaagacttcgatatgaaaaaaatcaatgggncatcaaatcctagnaggatattttatgnggatacctagcacccgcaatggnggnaaatggcaaaaactggtatgaccccgatttttgacgaatttttggtgggcgatggtgnaaactaaaaatttntcgct

SEQ ID NO: 1057 - DNA, 499 bp, Ctenocephalides felis
ctcaatgaaatncctattntgntctttttctgctttacaggatttaatgcaaactgngggcatannnaattggaataactcaaatcangttaaatgatctatttcagataaattattacagtatcttttcatnctaaaaattntatnccgctntacgcanttttaaaacggtctctgattattttaatcatnatttgtaataattaatttaatgcttatgcaagcattctnataatactgtaatttaaatattgnaanaattaaatgtttntaggtttnggactagtgtntataacagataaattaatatattattgtnggattgtatttaatnntttaaagaatattaanatcagtgtttggnttatatagttnngcaatnctgtctaaagtacctggttattttnatttattttaggatcattatgaagcaattgcaaananttatttncaaatttaaatttatatnttttttgaccangtgccaatttacttgncc

SEQ ID NO: 1058 - DNA, 310 bp, Ctenocephalides felis
ttttttttttttttttttttttttttttttttaatgatttaattaatttattntaagccaataattgatattaattatgcattaatcattgnatttatactttcctagaaaactatacatcacatgttgaaacaaattaaggttcatggcttctcgcctttccttagcgcttgttttaaatttgatccattctttccgaatcttgttactntttggtccccatttntcattgggagtgaacacgtttttcaatgtatcattaatggaatgttttctatttttcaaatatatccaaattgcccaaagnggt

SEQ ID NO: 1059 - DNA, 215 bp, Ctenocephalides felis; identical to SEQ ID NO: 517

SEQ ID NO: 1060 - DNA, 275 bp, Ctenocephalides felis; identical to SEQ ID NO: 518

SEQ ID NO: 1061 - DNA, 330 bp, Ctenocephalides felis
nnnaagccctttngaaaccctnggaangantctggcgccctttcccgtacatatccnagttaatatatattatagcttctaaaataattcnntcacgatgtttattttgtctcaacggtcaaaataaatnctgatttttttttttaaatgtaaaagatcaataatcaatgaagcaaagattttataaacatttttgctaaatttttatgtaattgaattatttttcatgctatatataatttatattggtagttaattattagagattttctaaaaaaaaatgatctaaaatttggaatagaacaaatttttcatggcggcctaaattgt

SEQ ID NO: 1062 - DNA, 126 bp, Ctenocephalides felis
tttactacttcagaattatttatttctagtaaacaacgaatttaaacttttagaatattcaaaattaattgcgacaagcaatattaccatgcactcttgaagattttaaaaaaaagtagttaaggt

SEQ ID NO: 1063 - DNA, 116 bp, Ctenocephalides felis
ccgtttgttatatattggcatacaaatgcattaagattaggctctgagacagtgattgaatgttatttttgttattttaaggaaatttaataaaataattattaaatcgaaaaaaa

SEQ ID NO: 1064 - DNA, 333 bp, Ctenocephalides felis
aattaaaattttctaacattcacaaaattgntnntcaaantccgaacgatattttcaaacaataataaattaacaacggacttagcaattataaatattacagctcactactacaaattacatatttttatcaatcatatatatatatatatagttttggtttaagatatataacaacaatgtttctatcgcacatatcattaaatatactttcatatgcgacaagacaagttttgcattaaaaaaatatatgttactaatgacaatatttagaatcacacttgaagactcctcctcggagcctncggggggcgccgagtaaaacaacaatgt

SEQ ID NO: 1065 - DNA, 498 bp, Ctenocephalides felis
agtagagaattgacagcagcnattgctgcggaaaccgcactcactgaacttcagcagcaaggaaatgatgttctcatggttccatttataacaaaatgtcagctgccattggaaagttttcgattgttaaaaaccagcaaagccatagtcaataaaagaagtttgaaatatcagatttttctgttcgagaatttaatactgtttactgaacctactattgtgaacaatgaagagttttttacctgcaaagactatatatctggatagaattttaccacctgtcgaatgtcagaagtctttatatgcatttaccctgacgagttcagaaaataaatctagaattttccatataaaatgctcaagtggcgatgaaaggatcgtccctggatgactattattaggaatattttgtttcagcaacaacaggcatgggaaaggaagccatngaaaaataaattagctttattctnccgacaggagggcttccacccaanaacc

SEQ ID NO: 1066 - DNA, 264 bp, Ctenocephalides felis
aaccacgagcattcctattgttaatgtcgtgactgacgtagcatcgatcttcgtttatcttgcagactgccactttagctgccaattccgcagcagtgttgcttgtgcaggtgtcatcattttcgttgcattttacacatttcaggggatcatttttattacataggttactattgcactttagacaagacccagatgttgcattttcgcattcttttctaatcgaatcagcttcaggtaaatcgaccaaacaacctttttttg

SEQ ID NO: 1067 - DNA, 498 bp, Ctenocephalides felis
tgtgactcatttggagttcttgaaggtggttcttctacccaagctttattagatccctgcatgctcatgttcaagctatgaccaggtggaggatgttcaattatgtcgaattgagagttacattgcgcactccttacacctagtgagttcagaactgttatattctcagctcctgattttgtgaaaagcatatattcttctaaaggntncatagtatgattgttgacttcaatatatatatttgagaggcatcctgaatagctttttgaatgtagcaaatctgggatcatctgncgataaaccaccgatttgtatttcattgattccttcttaggagattttacaaaattgacttcgggtaatatttctaaagatcttnaagttctgtctattaacaatatgggagcctgttgngatacccttttggnatnagacgggaatgcttagcaccgttttagaaaanntttctngttaacttttngcttccaaacacaagac

SEQ ID NO: 1068 - DNA, 422 bp, Ctenocephalides felis
taacctctaatgacgtcttaacacgtaagacaaggcaagcagatgatgctccaaaagaacccgatttcaacctagctaaagaatacaacgactcctacccggtggtttttaacatcattttatggttcggagtagcctttttcttctcgttacttgctatctgtatctcgatctccacaatggaccctggcagggactccattatttacagaatgacatccacacgcatcaagaaggagaattaaagtttgcgaaaggagtgtttttaattgtaaatagattgtttagtattattacaatgtaaccgagttattaatttgtgatcaatataaattaaaaattaaaatacaatatctttgttgaaaatcgaattattgntctattatattttttgttttacattcctagtattaccgaattgt

SEQ ID NO: 1069 - DNA, 288 bp, Ctenocephalides felis
catagaaatataatggaattttacttttaacattgtttataaactatactttacaaattaattgtaatatataaatataattatattatttcataaaatatttgttctctgactagtgtagatgttttcgtgctttctaaataagggaagttatataggcctgtatgcctttctgtgaacaactctatgtatgttctaattttgttaggatttatttttataaaaatgaatatataaatatataaccgcattaaaaaaaaaannannaaaaaaaanaaanaaaaaaaa

SEQ ID NO: 1070 - DNA, 498 bp, Ctenocephalides felis
aatttacaatcagaatcaatcttacaattagtgtagttgtctatgagagaaaacatcgggcgttggtcacaaaatgattaacagttatagaatgccatgtgtttaatacgcagtttacaatataatgttactattgttagttggcatactgtaccgagttttattttttttatgaaaaagaagatagagtggccaaattattttggtcatgtgatatttgttccattaaagattatatgagggcatgtgcattggtaggtgcatgatttaatatttttgtaccgttgcggaattgatttgtggtggagatactgtattaaagngtttcaaatagttttgaaactgctcttgtgtgaaatttagtatagtccccaattcaatctaagangncttgggtcttccctttatggtgtcagcacttggataaactttattctaccttatccanttattttagttannatgctccgccccttnggccagnatantttgaaccga

SEQ ID NO: 1071 - DNA, 269 bp, Ctenocephalides felis
caggattactaatgnccgcgtttccactgttncagnnattccgnaaaccancnaccncgnatatnaatatgaagctattggtnaatggtcaataaatgcacaaattatttcacaaatcccgcatgagaccatnacgaatacaagaattggaagctttcccacagaggtaataatagcacctattatgggaaatcaatcgcatatncagcttncaacattaaaagaatgcataaatgcctgntctttcattgngtctttacactcggncg

SEQ ID NO: 1072 - DNA, 498 bp, Ctenocephalides felis
aagatttaaacaatatgtaaaatatttatgtcttttaatttaaaatgaatttatangttttttactataactagttaatgaattatataaatattttaaatattgttaagcactggttaattttcgtataactgctatgcaaaatactgttagatttgaattaattttactgaatcaaatgaaaaaaagcaaagaaaaccagatacttcaagtaaactacacgtaaataaagaatgtttgcataatatgatattattatactcacaatgttcttttgtgcgaagtaattgacaagttttttgaatactaaacaggtatgtaaaataatatgtatataataattatatgcacatttcttaaataactgattagttgncaaaatcacacgaaatggtagctncccaatattttaaaagctacctaaatgnctaaatccctctggtcggaagctaagtagcatcaaaccatgtttncttatttacggtaaaattaacatta

SEQ ID NO: 1073 - DNA, 498 bp, Ctenocephalides felis
aatgnttncagatccagccnccnaagaagcggnttgnttgcttaaaccnatgngccaaatttgagatacnagctttgagcgantcagagttttcttggaaaatgttaatggtaaaatgaaaatatgaaaaatttcgcaattgngacaaagattttcctaacatagaaatattttgctgntttatgatagtaaattatttcataattagnaatttaattatattttaatattaattggttaataacatgcnaattaatcgagaattgntttaatgnttgatattttaacattaattgnggntgggcagatatttattaattatatgttaagttcgcgtntttgctttttatttaattaaaattaagattattatattcctnatcatgggttaaaaaaaccatgntntcattnaagggcnaagtaccccaagttttngnttaacaagggtttttaaggtntactgcagctangcctcngtattacatattcnacacttct

SEQ ID NO: 1074 - DNA, 437 bp, Ctenocephalides felis
caagaaacaagcataagatggccatggcaatgctattttatgaggcagaattgccatgtgaagatttttttccccgaacattatacaagattttccacttagattttttttattacgatagttattaagtagtcggcatttctgttgtagtagtagtaagtagtagaaaaatatgaaaaaaatatttgcaatttattatcaaaaactctaatataagtcccagatttttttatctaattttgtttattgatcaataattattattattattattgttgttgttgttgacgatgaaatatgatttatatacaacaaatttatatttaaaatagatctttataacttactgactgnagattattggtaattggnctggtgaccaattcntggtncccntggttccattaaatgaaaaaaaaaaaaaaaaaaaaaaaaaa

SEQ ID NO: 1075 - DNA, 324 bp, Ctenocephalides felis
ttttaaccctttntaaccnttngaantccccnngntttcggcnaaggcccacaccttgtgtangccngcttaaacttanancctttcattttaaatagacaagaagtgccattgggggganctattgattttgaanaaccaccattcnaaanctcttatggaggaggagatagttattcatattctgcaccacccnccccttcttntaaantgaganacaagtgctcctgcacatccagctgattatgaaccaacggagtatggngaatatgcttatcgtcgtggtatggattatgaagatacaggaagttccgctggaagtng

SEQ ID NO: 1076 - DNA, 497 bp, Ctenocephalides felis
gaaatatgataatatgttcaaaataaaaatgataaaaataaatgagtggattatcaanncaggatattaaacataatagaaattttttttgaaagttatggaaattttttaagaaaaggttaatgacaaagttgaattaattacctgtatgtttgaatatttgttagcacttttgcactaaacaagcttttttaacaaaaatgattttgtgagttaattttccgccgaataattagattttgtaaatacaaaattactaaaaaatttgtcttttttaaaattattatttgaaaacacgaataatattgttctctggatgttgttcgattggttttcgaaaattaactaaatgaaactggtgtgccctttgtacacgtgtaacacttgacgagagatgggagatggntggggngngtttttatatgtcaggggggaatacttaaattgtggatcttaaaaggaagtcgtattaattgtttgtcaaaaagtgaaaaaat

SEQ ID NO: 1077 - DNA, 354 bp, Ctenocephalides felis
ttttaaaccctttttnaacccttttaagttccgcgnaggtttccgcccgaggncccttnaattggtaaatatttataaactacntttttaattttgttcaaactaatttggatannggnttacgnttaaagctatatcaanttggataataaattattgtaagaatttactactcatttacacgataatatataaagcacaccataatataatattattttatctataatacaccatggctgttaaaaacaccaaatttatattctcaaatactaaccacatacaatcctgatttaaatttgtataatatacgtttcaactcaactaagtctatcacaagaaattggacgtagt

SEQ ID NO: 1078 - DNA, 387 bp, Ctenocephalides felis
ttgntaaacccntntnaaccctcntggaantccccaannntttccccngcagccccnaataatnntacttcnagttaacctancacgattattnttataatttttttgntaattnnanggtctgggnctngatgtcacctcactgnncatatgaaacaaanatgtgacgctctttataaatttatcactaccttatctataatcatatcacctcacataaatttcataccatggttgtatttacaaaattcagacagtagttgcagagatgtattcgaaatttgaatcattaaacaaaaatattttgataaaattgatatgtctctccttaaaaaaaattgaatttctcatttataattatttcttgntctgggcatatgtaatagt

SEQ ID NO: 1079 - DNA, 467 bp, Ctenocephalides felis
cgncaccaatgggttttcccnaaatttttnttcggnccggaccnggnggcaaaagtgnaaccgttttttccgnccgaggagaatggnaaaaattttnntcatggttttttgggtnaccaccaatnggcaataaaaccttttggttggcccaatnggctngccctttgttaaaccggggtgcgngcatccccccccccccgcgaagnatgcaaagtggagaatggttaagtagggcttaacccaggaaaccatcttgatagactaatnnggttcaattatcataagtagtcattatttataatccacaatgactggcattaatataaaaattgttaaaattaaatgttaaatgttttatgtangggccaacaaangcatacntgtattctggtattaaatttantttgagcttttgatctgttttttataaataacgttgccgcttgaaaaaaaaaaaaaaaaaaaaa

SEQ ID NO: 1080 - DNA, 489 bp, Ctenocephalides felis
annccnccntcaccgaangggtttgccccaaaattttttttggngcngaaccngctngcaaagggggnaaccgttttttccgnncnaggagntggtaaaaattttttccatggtttttnggttaccancaaangncaantaaaccnttatggntngtccaaanggcttggcnctttgntaaaccggagttgcgatgcatncccncnccccccggcggaaaaatgcaaaagtngagatgctaagtagggcttaacccaggaaaccatcttgatagctaattnggatccaaatatcataagtgtccatttaatataataatncacaatgactgngcaattaatataaaaaattgtttaaaaattaaaatgataaaatgtnttttatgtangngcncaaccaaaatggcattactttagtaatttccggtttttaaaatttttaattttgaagcctttggaattncntgttcttttataaaaataaatcgtg

SEQ ID NO: 1081 - DNA, 386 bp, Ctenocephalides felis
nacctcnttggatttgccccaannggttttgggccaattnancctttcntaccnttnncaaattggnncggtanttnccgacggtttttttaaaccaataattaaggggccaccgggntnncanttntnaantnttccagctcntancncnaaataccatattttnttcaatcatntatntntntaatttaggtttgggtttnangaattataccaccaatngtttctatcggcncatttaatnaaatatcctttcattatgncgancaaggacaagttttgnattaaaaaaantttntgttacttaatggacaatatttagaaatcacactttgaagactccttcctcgganccttccggggggcgccgagnaaaaccaacaatg

SEQ ID NO: 1082 - DNA, 436 bp, Ctenocephalides felis
gaattngncaggcagcanttggcttgcgggaaacccgtcctcnctggancttcaaccaggnanggaaaanganggttcctcatgggtcccatttttaacaaaaatgtcagctggccattgggaaaggtttccgattggttnaaaaaaccagcaaagccattagtcaaataaaaagaagtttgaaaatatcagatttttctgttccgagaatttaatactgtttactgaacctactattgtgaacaatgaagagttttttacctgcaaagactatatatctggatagaattttaccacctgtcgaatgtcagaagtctttatatgcatttaccctgacgagttcagaaaataaatctagaattttccatataaaatgctcaagtggcgatgaaagatcgtcctggatgctattattaggaatatttgttcagcacaa

SEQ ID NO: 1083 - DNA, 497 bp, Ctenocephalides felis
atntttngntnccatngctcaanggcgntattggccccncagccgggcgtccaaaangctncntngtccgcaccgncttantcgtttggcangattatccntgtttaattttcgcctttcgtccccaaaatcttttgggatcttgatcatgtaaaagtgntttaacggctttgcttcgtatgcatgcaggtgcattatctacgagaagaaaaaaattggttgctgggggagagttacaagatcttatgtcgagactatgggccatataatcaatgggtgggggctggagaggatctgntttaagcattgctgaggatctgagaaatcgtaaatatncgatccattcatggacaggagaagtaatgattnctgagatgcatggctatggtaaaccatccgcattataaaaagnggttgccnccgcgtncncccatcncattgntgtcaattattnactggctnctgacaatgctntggcgttccaagatnncctcatc

SEQ ID NO: 1084 - DNA, 281 bp, Ctenocephalides felis
aagtgtaactgtaattgatccnttttattttaaattacagntanaaattccgnnaaaatcttnacccgatgatatcacaaaaacgacttataaaaaattattaaagcaaatattgnttttactcttagaccgcggacaatgtgccatattgttgtaatggatttttgatagaaatgtagctttaaaaaaaaacatcttgactcggnatttattattattaaatcatcaatttgtgtgctttacaactaagctatatttctgatccaaaatgcaatactcgt

SEQ ID NO: 1085 - DNA, 489 bp, Ctenocephalides felis
ttttttttttttttttttttcgntttccgcatntccacaagccaaaaccaagcctgngccagcattaaaaacccaatccttntcgngttntttcagngctatttcanatattaactntgtttntaaccgnntnaataccttttcaggatcgcgtatggcctcatttttgngtgtnaacctgnggncaacatcgccaatccatgttaccaatcgatccttacgattagcaaacatttcaccgagtcccaaacgttnttntaacctatggnactgnatagctaattganggcaanancgccatgctgttgcncagaatccaaaccattngatttattggtttcatatctgntggactaacgcattcttttagttggtcttgagaaactctaaatcttcaaagttgggngngagaacaactaaacgagngccctgaatcgnaaattntccaaanattncncntcccggttttanaagangggaactggngaa

SEQ ID NO: 1086 - DNA, 389 bp, Ctenocephalides felis
ccnggccaggtccattccaggangtgggaacctttttaaggaagnctcctnanggggggcatttnccccnngggggaccgggaaaaatcgcccattagcttgggtcggnccctggccnatatgtaatngnccaagggggtatcccctctttgcaatgggtgggaggttggctgggaaaaaggtactttactcctatcttctcaagactggcaaagggatttaaacttctttagttggaatttgggggatattagattagaaatataatggaaatgngaatatagaaaaaaaattaaatatacaatagtattttaaattggccacatctatctatgcatncataaataaaggtatatacagcattcaaaaaaaaaaaaaaaaaaaaaaaa

SEQ ID NO: 1087 - DNA, 499 bp, Ctenocephalides felis
ttttttttttttttttttggtaaaaaatttttcttttattaaantgntttaccacccanataatacctctggcntaaaattggaaattattctaacaaaagtttggggntatggcatgaatgccacttaacactaccagcaattttgtctcagcataaaatttcataaatagaggagctcaaaaagacaaaataaccataatatagtcattaacattaacaaaaatataatattatctattaaaaagnaaagcaaatataatctttgaaaaatattcttacacacactcacatatatatgcctttgcatagactccgaatggagcgagatcaaaataataacatgggcatcatcncactcaaagacaaatagtataataataatatgcgggtaaatatcattcattcattttttttttttattgccggttatccgnggcccaataataaaantnaattttcatattaaatttaaagncaatttggttaccgnngaagga

SEQ ID NO: 1088 - DNA, 303 bp, Ctenocephalides felis
tttttgggcaaaaagactaacaattaataaccaacacataataaaaataaattgntgggatagaaaattgattcaattttctactcgattaacaaaattgncctttatctgattatgngntgggntttattatatattattattaatattgatcgatggatttaattacactgattttgcatttaagtgagtttatcctattattggttggttttggtatttaattaattgaccagcgtgagaagaactttcttgnagtctcctgatgtatcgncggagatcagctctccaaactctttccgt

SEQ ID NO: 1089 - DNA, 498 bp, Ctenocephalides felis
acctaatattataatattaaaaacaaatcaataaaataaatagcaaagtaaattttagtgttaactttataaataccaatcatcatttttatatgatttgtataaaaacttatattccataaaataatttatatatcatgaacatagaaagtgtttatgtatcatttcattcttatatcaatctaaaaattataatattatgaaatataaattttagttgtaaaattgaaatatgtcgaggttataaatcataaaaaattataatataactatacctcctaaaatagcattgccaatagtttgtttatataaacttctggcgatcgaacttcttttcgttcatttcccgagattaaacatgaaaagcccacggttttcgaatgcattgaataaaatgatttgcttaatcgcagcctaatataatattcatcaggctattatgaaaatattggatacaatttttatataaaaccattctntagaaccattagaaaatat

SEQ ID NO: 1090 - DNA, 499 bp, Ctenocephalides felis
cacccccgagctttcnaattggtaatggtcgggactggacgtngcatcgatctttcgntttatcttggagactgggacttttagctgccaattcccgcagcagnggttgctttgtgcaggnggtcatcattttcgttgcattttacacatttcaggggatcatttttattacataggttactattgcactttagacaagacccagatgttgcattttcgcattcttttctaatcgaatcagcttcaggtaaatcgaccaaacaacctttttttgtttcagtgccgntaacatagatgtaacacaatccttcacattttttttctcccccgcatccgttgacatgacgggcgctcgaaatcttattattgcatgtagcaccgcacaagttttgcaaagagtattgncatcgcagatatcctcgtgcgcaccctcgattactttaccttttctagttagcgnagcataatctccattcatatgctaacaatcttgcttcga

SEQ ID NO: 1091 - DNA, 500 bp, Ctenocephalides felis
cctggctaanntttaagtgcttgggattctataaaanttggnttttaaaaaagctggatttataatacaaagcagggcttcnttttcgatttgtcacatatatattaacttttttcaaatcaatttatctatgcatttagtttatccattttctaacttacaaaatataattctaaatagttcaataagtaacagaatctaataataacataaaataataatatataacctctggacagtaaacatggtagagattttaaaatgacaaaacacattcttgaaaatgaagttcaaaacaatatctagttttgatcaagagtttctttggttatgactaaagttttcaaacatcacgtaagaatggnaataattgacttgaataatgcttcctatcaatcaatttttatgtaaatcataaaaggtaaaattaaacaggantgctgntataaaattactgncacttccccaaaatattatttcatctctaattaccatagata

SEQ ID NO: 1092 - DNA, 308 bp, Ctenocephalides felis
ccccttcagtaatttctttttatttttaaattancgaaaaatcaganaacagttattccaaagatcatgggncttgntgnncttctttaagcttatttcctatcctaaagtgttaactattactacctaaactgcgatgatatttgtgatgaatgatgttgacatgatgtccgaagacgttggctaagatgcggnataattctgttcctggtcatcatcggttccctttcctggtaatctttacttgttcccaatcttcagcacggccgttctaacgtggagcaagcttcgagccagtttcttcaaag

SEQ ID NO: 1093 - DNA, 498 bp, Ctenocephalides felis
tatcagtatcacccttacgtgaatactccgaaaaaatcattgaagcacgaagaacagaagcaccttacttactaccaccgcttttaagccactacgatagttcccaaacaagacctttatccagcttgcagcatctcatgatcgatcaaaacactttaatcgaaggcttgaaattggttggtgtcgatggatcttcattaaaacaactagctcactttgcacattgcccgataactatgaacatgggtcacagacatagttgggtcgaggctggcacttctttaggaagtgcttcggntttgagctctttaaacaacgatgtggatagcgcacaagntcaccaggattatccaggaaaattaacacccgaagaatattctttttgtgtcatggaacgagcagtaaatggaccaactgngtctggacaattactgnaganggaccatntaacgctttgccaagcgtttanaaatgancatttntgaatgtgnnccnaac

SEQ ID NO: 1094 - DNA, 228 bp, Ctenocephalides felis
cgttttnacagcaaaaaaccaagccttgattggccgaagtggtcgggtggcttctcatgtggattcatataaatcaagcttttgtggttgctttgtgatgaatgggtgctttggttgaaattggntcttcatggttcatttaagattcaacgatcctggtgaattgggntgaaccaactcggctccaaaatcaggcgacgaagaagagctttcctgaatcctctccgt

SEQ ID NO: 1095 - DNA, 308 bp, Ctenocephalides felis
cctaatggnggttttangctaaccangaaaaataagggttaaaaaaggncnaaccttnaaatgggataaaanccattaaaatcantttctttancacattctagtcacacactttgatccgaaaggttgccccgaatcggcagaatttatgaattttattataaattcacaatgatcgcatcacataaaattgnctttaaatctgnttatcttgcaggaaaaatatcgcaaacacgtttttttntggcttctaactcaatatttaacacacgtaaattatcacaccgttaggcaagctgatggnctgg

SEQ ID NO: 1096 - DNA, 335 bp, Ctenocephalides felis
ctttctttaaaattgtaacatctatatcatgaaatcatgatcggctccctggtttatttctaccgattactacagtattatatttataatatgttcaatatagcactgnggtccaattttattttgaccaaaggtttatataaaaatccaggttttcttgatcatgtaaaatgntggtccattatcttaaattattatattcagaatgatatataatccattcaactttctaaaacaaacaagaaatctgtgcaacgtctgatatctgngaatatgtattggatttaatatatatgttaagngnttaaaaatatatttctatttcatatacttgn

SEQ ID NO: 1097 - DNA, 500 bp, Ctenocephalides felis
ccttagacctccaaatctttttttaaggaaaaatcccccggaaaaatagcccttncatattccgcctgnttatacttgtgacaagnttaaaggatttaatttaagcgacttctgtatttatgtaattcacctactctaaattaagactgnaatttatcattatctgacatagttttttggttttacgtattttttattaaaattcttgtgaagttcaacaagtagaatattgnttttttaattgggttatttggaccttagaatattctaaaatactctatttacatagagagagcaagatgcttaaatttatacaatatgtcgagtaaaaccaaaaaaaacgtaaacttgcatgctttctagacatgctgctataatcataaaaaacagttttgccatcttgaaataaggcagacttatattatatacattaataatggntcgacacntattgtgntcattggaatgaaataatcagggnggaatataattttcttntg

SEQ ID NO: 1098 - DNA, 392 bp, Ctenocephalides felis
cacnntntttntntaagttttttccctgtaaatngtaaatatgantttggttngngaaaatagtggcnggggtncatgttaaccaaaactatgggacctcttggataatttaatcacttatttatatttgcccgcgtggtaatatttaagatatgaaatctatagaagcgatcctttgtatgacaaagttgacattgttaatcatatatccaatgatttgcgacatatgttatggtgctatttgcccttaaaaatctacatgtgtagtgaatttgttctgcttctacgtgataaatgcttggatatagngtttgatctttttataaatatcatatatattggattaaacaatcaaaagaaataaaaatgtaaaaaaaaaaaaaaaaaaaaaa

SEQ ID NO: 1099 - DNA, 362 bp, Ctenocephalides felis
ttttttttttttttttttttttttttcanttttctatcttttattatttaagccataaatatatatatagtataagnataggctaactaccttttattattcccgaaaccatttcaataatttcaactattcttagattttctttnatttctcagacaaaaccacatatgcttgttaatctcaaaacgaataattatcatttttgtttatgactatataattatacatatgcgggcctacttagtattcanaaatactttatacaggnagcttatcattttagataatatcattcaattttgttatttgnattacttcaataaaaataacacctaatatattttttcaattgatgaaatatg

SEQ ID NO: 1100 - DNA, 498 bp, Ctenocephalides felis
caangaatatangggtttttantggcaccataatggcttttaaacttggggttggttggaaaaacaaatttgggttggaggggataaccgccanttttaggattcaaaatacctccgccaatcacacaaaaacacttttaaaattccttctaccagaaaaaaaaatggcaaaaagaaaaacacgtttttaaccagttacaggagtgntactcctcaatccaatgaaattttatgcagttctgttcaaaattatatctgntgnaatatttaaaaaagttaaacttttgcttaaccaatgaaaataagatctcaatagaagacttaaattaaatatgatagtgatcatgagcatatgttcataaatcaactttctgattgattttctatgataaatgcattgnctacactatttacttactactacacggtccttacaggaatgnatataaattaaaatatgcatatatttatattcattgngggaaaccggatttggaa

SEQ ID NO: 1101 - DNA, 319 bp, Ctenocephalides felis
ctacntnaaagggggtggcttttcttaagcagntggcatancccaaggcagcacccactgcaaanggctcttataaaaaanaggtatttctttggcaatttaaattctttctttcanctgtaagacccgtgatacccattttttttggcttttcttttgatttttctttaagcaattccctctgctttgtcaattttcctatcaacaaatctctcaattttatccattaatttaggagtttctccagtaacaagcctcttcaattttatctgtcaccttatcagcctttttagttactttatcccagtcaatagaaatg

SEQ ID NO: 1102 - DNA, 283 bp, Ctenocephalides felis
ttgggcntttggtnggtattttaanaacaagaagcattttnttgggacttggacttttcactactcataagaaagcatcaaaagaaaactgggnctgggtattttggtggagggttgggactaaatatcatcgatcnggggttttacttaaaacttttccctcatatccttaaaaatctcttgatgggcttccaaaacttgtccgagaatttcacaaaagtaacctccgttccaaaagaactttttgtcaaaacacgtggggttaaaagtgcaggtcacaagt

SEQ ID NO: 1103 - DNA, 287 bp, Ctenocephalides felis
tatcaagcaaactgaatttgatctgaggtaaaactgaattcaaganataaaagcatcaccnantatgtatagataaaagataaagattgtaaaaagtttgagaaacactgtttggatggtgaaacgaaatatagaaaacacaaaagttaaaatatatatatactcagccccaaataatataatttaaaattatggttaagtttgtttagtagctcagtggtaatagcattagccttgcaaccagaattgcagattccattccctcattaaacctgatatcaagcagt

SEQ ID NO: 1104 - DNA, 434 bp, Ctenocephalides felis
accatatcntatttttggantaantggaatgncatttaatttggctactaatacttctatggaaattcattttttaaataaggtggnttaaataaataatttcattgnaaagncacatcaaaacttttctccaaatatagntctataatatttagtttttagcctgntatcactattagattaaattataaattgnttgnaattggctaattgnaaagngnttataaatgaacttttgntgncatttgntatgaagatatatgtattttgaagcatattttttgtaacattgtgcaaatgcttatttgtttggttgnaataggaaaataattatgattcttattactcattaaactataataaattttagcccatggtaaacattacaattaagtatctatttagcaaaaaaaaaaaaaaaaaaaaaaaaaaan

SEQ ID NO: 1105 - DNA, 498 bp, Ctenocephalides felis
ntttgagcccctcggngtcttgaaagcccntnaanggggccccgggcgggggaccaagcccaaaggnntatttggttctttcnacnggtaatcaaaaattggccttttatattttaaaantggataanttaagntttantanttggcccccgganaatcgggccataaaaaaaaaaaaatggatggatggtttttaacncccnaattattattataccatttggtctttgnggggggangaatgcnccctgntattattttggaccccgcccccttcgggggctatgccaagggntatattgggaggtggggggnaagaatatttttcaaanantatattttgctttaccttttaatagaaaatattatatttttggtaatggtaaatggctatattaatgggtattttggtctttttgagcccnctatttatgaaatttatgctgggaccaaattgctggnagnggtaagtggngcattcatgccntaactnccaac

SEQ ID NO: 1106 - DNA, 500 bp, Ctenocephalides felis
ggnnnttttgaagcccttnnnnnaaangaagctcttngnnagctcnaatnncgttnggccgaccggcccggtncaacagtggcatggaccttggcctttaacggtcanttctaaggatgggggttntttantcttggggtgggatatggctttangggccttaaattcttnctnangancccaaattactaaatcannatncaagccttntttggnttggccttttangncatccaagccagntaatttcgcanggcccgcagataataaacgagatcatcatgagctttaaagncctttttaaaancaccgggccataataaanatatncaaactggataccaacaattncaccccaagcttttaaggaatcaaggnggacaccattgnacaggccttnantgcacaagtggaggngaatgacactgcttncatatcatatctttgttttcaaagcttgcataattttctggataccttcttctctaatgggggacgca

SEQ ID NO: 1107 - DNA, 370 bp, Ctenocephalides felis
cctacctttaccttctcacttacccttacctacgctttaccnacccttnccnacccttnnaccccgggcctttttactggttactnactattggctaggggntttggngctnaatcnccnncgaagagctnctnnaagaaagaacaggcaaattttggntnacaacctncattctttgntaccnatcattantatggcnactactctatggncaccnatcgnttaacaatcaggcaatctgntcttggttttgggggncggggattgaaacccgaatcgggnttcgaaaatgaacannaatatttggccntattaaatggtggtaaaatatnccaattaatggattatttcatcactttcgnaannnaaa

SEQ ID NO: 1108 - DNA, 149 bp, Ctenocephalides felis
tttttggtgntatatcactttcctttgcaggtgcctntgaaccgggcgtcttatttaaatcatcgctttcttgattattatcctcagcgctttcctgattggtatcgtctttatgcgtcaaagttgccaagatcgttgcattatttggt

SEQ ID NO: 1109 - DNA, 498 bp, Ctenocephalides felis
atattagtaataagtggccatcaaagatattaaaattaatttgccagtcctgtttattgggggangaacttcaaaatcatctattacaaggattatttcaagtgccattggtagataaaacataaagtagatataccttaatgccaggagtatatatataactaatgaaaaatgaactaaatttgaactggatttcaaattttgactggatctgtaactttttgtagttcccttctattaaataggatatttgtattcaccgcattttatgacctgaaggaggtcaaatattccactgtttcttttgcataaattttattaagtgatagtaagaattttatacttagggctaatcaaaagagccggcacacttattttttctaatttcataattaaaaattggctatatttgtcctaagttgnaaaggtcttagttattgnaaaattatattatagcgatagattcattttcattgtgggatgacttattgattgaca

SEQ ID NO: 1110 - DNA, 400 bp, Ctenocephalides felis
tttattctataatgaaatgaataatgntactccaaatataatagtatgtctttcatggnaaatttatatgtatatatattatatttatatatttgnatatatgcacaattgtgtatgcttatatctttacatatgtgcaaatatagttttatggatgtatatagatgtgtaagaatattttatgtaatttttattaactcgtttaaaattgagtttattacttctaaaaccacttgcaatttgattgactttttggatactgntctaattaaagtatgatgcattttaaatatgaaaatagaaatagttaacagtaaactaaacaagctttgttgctagtgtaaaatggaaaaatcatttatgtttttatagcttttaaacatgtttcaatttgataagg

SEQ ID NO: 1111 - DNA, 379 bp, Ctenocephalides felis
caaatattggtgcatcacaggctcatgggatatttataaaacatagaatgnggggaatatatcaatcatataaaatttacatgcttcatactagacaaacaattaaagatcaaacattattttttatacatttatatataaaattgaatgatcaaattctttctttgcaaaaaccacatattattgaagcataaatttagaaatcaaataaataaaatagcacaccaaacattatgttattagtttatgtgtcaaatcacatattgttataaattttgagtaatatacaattataggcgtgttttttacatttttcatttcagaggtctttaaaacttatacaatatattatttactattattgttaaaacggtttagt

SEQ ID NO: 1112 - DNA, 486 bp, Ctenocephalides felis
tttttaagnccccttnttgaaagccctttggggnttanccgtgggtccnngggcgggggtccccccaaggtggnattgggggaaancntacccnccaaattttttttaaccaatttanttaataccttantgggcctaagaaaaggccgaaggtggtaaaggttcaaggggttggtattagcttaantaaaaggtaaaactttttaaaaanggtgatggaatttatctggcaaaataggtccaaaattcaaaaaattactattattaatggnntattggaaataatgctttttattaggaattggcattttcaantctggtatttaaaattggtntggtaaaatcaccagcaccaaggatcccaaccacacantttcatctnaccagaaagaacnaaaattaattttaatggttattaaaaattacattattaaaataactttttacnaataaaggtaaccctacnttgagaatggtgttggtttc

SEQ ID NO: 1113 - DNA, 500 bp, Ctenocephalides felis
ccgacnggtggaaattggcantgganccagccnaaantggnngggcccgggcaaaggtantaaaagaantggggattgggcantttattgacgggggcaanaacttttggcgaattttttttaacacatatttttagaaatggacatatcatagttagggtggggattcgaaaaactgnctttancatcttttgaaaataaggtatnttgggcagnctttcggatctggctgatatcctacaacccgcgccatgtagtttctgccgcttacaagttttcccaaggttttgatgagccatatcatctacacaaaatgggacatcggaattgaagctctgcaatngattggtggaattgggggttctttgtcacgccacttcaaagtanacaatcgtgacaaatgttccantggtattatacctnggccggacccgctaagccaaatttgagattcatnaantggnggccgtngagctgctttaaggccaatcgcctatagn

SEQ ID NO: 1114 - DNA, 500 bp, Ctenocephalides felis
gctagctacaagttgttgaaatattattaaattttattattatatttgttttttttctgnatggggtttaaattacattccatgataattttcagttttatataatctaataaattcaatttaactgttgaaatttgatcatattgtgtatatacatagcaatataaaatataaagttacacattgtctgtttcattataactgtactgcaaaattaattattttgattgtttgttactgtattattaaagttattcagattcagtcaaaatttaaatgtttggcctaaacttattattgaaatattgccaatagtgtattattacttagcaattatgtataaagattttatttattaaagcaatattcgaatgtctgtaatatcataaattatgtatataaataaatatatcaatgtgaacaataacagagaacataagctcaaaatcatcatactatgtctggaaaatcaaatataaatngtttttagngtaaataaa

SEQ ID NO: 1115 - DNA, 500 bp, Ctenocephalides felis
ttttntngttttttttttttttttttttggggattagaaaattaatatttcatttaaaaaaataatggggtattacaggattattgtttctataaacaaactacataatatggcatgatttttttcaataatcaatttgattcgcaaatgaatcttctggctggatgcagattttgtcgttccatccttccttgctggatttgnatactgcttctacacaattttcttttcctctgtaattatttgggtcaccacgaacccatttttcaaaagtcatgggctttgaattttcaatatgcccacaaattttgatcgatctgctagattgttaccagctgtccaaaacatttgtttggcacggtaattgctgttaacaaatttctcaaattttcatattgnaatggagntcaatggntgccaccctgcgtccaagcttttttaccaaaagcattttggtcaaccagttcacttangaggncgaaaatgaaaactttttccgt

SEQ ID NO: 1116 - DNA, 317 bp, Ctenocephalides felis
aggggaaaattcttttttttgaaaactgggattctgnagtttgcncgccgggtggctttgcgacgtttttagttccttgaacgacataatcattattcatttcttgagagtctatcaaactgattataattgcttcgttttcgttcaccgcagttttggcttgttttatttccggtttcttttgtagttcaagttctacatttgtctgactcattatattttcggttacaataagaggttcttgcggtttttgtattaattttgcattatctaatctcttagtatcttcaacaaactcactttctttttcacgaagt

SEQ ID NO: 1117 - DNA, 307 bp, Ctenocephalides felis
taccgtattcaggtcccaaaccatcattaaaatggtagcattaatcaaaaatcaaagaatcattattcaaattccaaggaagtaaaataaaaaataatttctttattcacttattgggagtgagtataaatctaattttggattcccgatgattgttgcaaagctccattagtctttattaatacatttttatttttttatttatttgcattgtaattgttgattcagacaccgcacacgaccgccgacatggcgctgtagtcttgctcctctgccggccgtaacgtcaaagtaatttggttgttgt

SEQ ID NO: 1118 - DNA, 374 bp, Ctenocephalides felis
ctgggggaaaggnctccaaccnagngnccggttttgcaaaaaaccactcttggctggtttggaattctcatctattaaattaagaantcttttgcttcatttcaattattttcaaaatatgattgatctcttcttcagttggnggntcccggccgtctatttcgcaaccatgcttccattctgcagggaattcctgatcaaacttttcttttattgntggctcaaaatatctattcgctttgcgtttaccaatgctaggatttcctggagtttcataatacttattgcctaggtgatcttttccaataaagtttgctttaatatttgcttttccaatcttgaatgagttataaaggttttaaagacttgaaggn

SEQ ID NO: 1119 - DNA, 498 bp, Ctenocephalides felis
tttatcaaaaatcctagtttatgagtagtgtgaagccagaaggccgtaaggtcgtgaaagatctgaacgtccatcaacatcttcaatggatgaaatcgtcgcctaagtcaagaaatggtgttggtaaactaccatttaggttcagtcaagttagtttttgaccttaacatatctaacaaatcaattataccatcaaattgggcatgagacgctttgctgttcatctctaccatcattgttgaactctcttcacacaacgcctatattgtgaacgcttttttggccataaactcatgaaatatcatgggacaaccaacgtattcactagatctatccttctgtaaattatttattgtcatggatacttaagtatagaattacaagtaatactattgttagatacctctttggatcgatagattccactacaatggttggtaagaaaaaaacgccaaagggctgaagaatatccttataaaggcgtttaaaagatgcttt

SEQ ID NO: 1120 - DNA, 455 bp, Ctenocephalides felis
gcgtnacatatctggaatttttttggtgaattatttttaatgtaataaatcatagtaatatttatttccaangtgcaaatatggaaactaccatccctatattatatataattgtatatattcctgaattgttttatttgaatttattttaaacacaaactttaattatattcaaataatgatggatgtgatttcatatatccctaaactttggatcagagtttgagagaagcctagccatagtgtatagaaaattatgtgtaggtgtataattaagattgcaggagtcaaatatataaagcattgatacaaattatacattccaattttctgtaaaccgtgttctttggttgattatggtttatatcacaatttatgaatcatgtaaattaattgtaaatttgaaatgtatctncgatgtnaatgtattgaaaaaaaaaaaaaaaaaaaaaaaa

SEQ ID NO: 1121 - DNA, 500 bp, Ctenocephalides felis
cttgaagccctngggagnacnnaagcccttcggcgnccgncaggggcnnacctcccggcaggggctcgtggggtagttcttggcaaattaattattattcattaatatggatttatatngatatggaataaaaatcccagcaatcacattctatcaaaaataaacttaattcaattcagtttggaaagttttaatcacaaagtctaaattatcataaatagccattatcaactgcatgccgaacattatccactaatcttaaacgaccttctttatgagcaattggacgtactttccatactgttgttataggcacagcatcatcgctctctatcatatccaagtctgggcatcatcatttttcataagagtgaatggcactgattctaagctgaatcctaaaccaaattttgaatatatttttaactcatcatgaaatgcattttttggatacattttttctgggctgctcccaattctttaattgagtagcataagcn

SEQ ID NO: 1122 - DNA, 500 bp, Ctenocephalides felis
ttggattattgnaagacaattgcaattatatttcaacaactggnttagttaccgaatataatttataggattcataaaaactaattgngttcaattatcattcacaatattcataaataagcaaataaattattcaataaaatatataaaattgatgtttctgtaacatatatactataagataataataggattgntagaaaactttaaattaaagtgaagtctatttctttagttctttaaggggcttgcatttagatcaatttcaagactattctcaggactagaattcaattggacattattgatctctgcacgatgttttccatcagagacagtcgttacgcttctgtaaaatgaggaccaagcgggcatttgattggtggtagtgncgcattctgaacttccaaattgtggcngngnatcgctactcacgaagnatttcggtaaattcctggggcattatctaaatcttctattggtttagcatggtacagttn

SEQ ID NO: 1123 - DNA, 415 bp, Ctenocephalides felis
tttttcntttcttcaanaaanatnttttaaanaatatgggggttttgttttatggggggccttacatattaacttttgatagcaatataaagtantcnnanttatttcgnggatcctacccaattcctttattaaactggnatacttcttatactatcccattatttttattaaatatacacacaactttaaaaactnccttntggttttatacaaactttaaatatcactccttttttaccattaggatcgtaattaatttntacctaaattatntgacctggtaaatgtttacatacatttacctttnnggcatataaatttttttagtttaaataaatgctccagaaatattttttattctnttntacatatcaacttaattcctagtttttcaaaatnaatattacacagt

SEQ ID NO: 1124 - DNA, 382 bp, Ctenocephalides felis
ttttttttttttttggntttttgganggctgggnaaaaccnttatttatgggngcataganagaaggtggtgccaaaattaaaaaaccattgganatttaantttttttctatattcacattttcattatatttctaaactaatatccccaaatttcaactaagaaattaaatcctttgccagtctgagaagataggagtaaagttacatttttccagccaactccccattgacaagagtggcatagcctccttggccatttacatattggccagggcacgaacacagctaattgngcgattatttctcgatcccactggnggaaatgacacctctctagtagctttccgaaaaagtttccactcttggattggcttgacgg

SEQ ID NO: 1125 - DNA, 500 bp, Ctenocephalides felis
ggcgggggctctggaggacccaaaaccnttttccttttttaggggttcatccttcttgggggctggttttggncgggggatttttccgccttggccggcgggnttttgcgaattgggaatcgttgggtgaagnctggagtaccgaagggaacagccccaccacctcgtctggttgntgggaaatggatcttgatcctggatctttcgctgaaagaattggggtctattatggncttattcggtancccatctacctctacacccaaataaaacaaaattatttatgggatttcaaagaatacaacaagtcgccctggctcccaaatccccttaatatatatgcaagcagtgcagtctgtctattatttttgccactcacacttaaaaatataatggctggcccgtattttatattatattggttattccagaaagcactgttgtattgaaaaagatctgnaatcaacacatctcatgtanggtactttntttgaaaaggt

SEQ ID NO: 1126 - DNA, 301 bp, Ctenocephalides felis
tgtgaaccggcaaacattgtcagtaaagctgcactcatgaatttgaggtattgaccccaggatactccggcaggcattgtaatagttatagttttaaatttggattgtcgagggcaagtttttcctcaactatggttttggcttggcgacgcttgtaaactttatagaagttcgtttccccgacttgccactttatcatagagaattctagcgcagcacccaatacaaagaatattggtaaaaaactatagaatccaaatttacgtcgtcctggccacttactcaaaaaagagcgtaatgt

SEQ ID NO: 1127 - DNA, 500 bp, Ctenocephalides felis
cgagaaaaaaacttttcttggccccgatttaacccctggcgcctcanacccctggagaanctggtggntcaantcttttaaagaaaaaaaattgncaaaaactgggttgactggcgttgaaactggtaaaaacaacgacnaattaaatataaaaaattgngagaagaagcatatcgaagaggaaaatgaaagggacgatgccccattgatatctgtgcaaaggacgtgctggaagaaagttataagcctaatggacctggatcttctcaaggatttgacttttcttaacatagtggtcggagtcgcattacctatccgccagtatcaatttcagcatgttatttccattttttttgcaagaatcaactggactaaaccgagctgatacagcgatgtgcatgtcagtctngctggggcgggcattggttctcggtaactcttccacaattacacaaatctgggatttcttgcagatggctacctatcggactgccgtctaa

SEQ ID NO: 1128 - DNA, 500 bp, Ctenocephalides felis
ttctcaataattaanacttcatggttttattttttaatatgatgaagactgcagacgactatcacattttaattcacaatagtgaaaaaaaaatacgactcacaattatatgtatctttaacactagttgatgtaaaaaaaagatcacataatttatatttctggaaatgcaacttgcataacataaggccacaatttcatatgaaattgaaagtaaaaaatacttaacagttgaaaacaactaaataatgaacatgaacaataggaactatattcgacaacaaaaaatattctcaacaattatttcaaatttctaaacagcaaaattactaggcaaattacaaaaattggntccattacatattggatttaagtaattaagactaccgctgcatctgccgatggtttctttcttgcatgccataagttttcttgaggcagcattagcattgntttaaggncttggtacactttgcctaagggggaaggtcttgggcctt

SEQ ID NO: 1129 - DNA, 500 bp, Ctenocephalides felis
aantaaancncctttggaaaataantgaaaactctttggcagccccngcaaggtccaattncggtgggtgcttaagggcttgggaatcaaaaattggncccaaaagantttacttcttgaaccccgaaatgggaaaaagaacaccaaagaacctttcacctttggaaatgggcaaaagaaagggattatttgggncccgggtggtanggtggtccaaccccttgacatggggaaactgggtgaaacgtgaaaatggtcatgggatttggcttgatccatatgcctaaagaaccatttgggcattttaagatatcaaatgccccacgctttgttgttacttgggcaaaaccaaatcaacccaaagggagggtatttcacggnccgtgtcttcttgcnacttggacgtggtggttttcaccggctttggagaacttcatcaattgaaacttactacatgagcatgantgggacaacaccttggatnggggtgggnaaacttt

SEQ ID NO: 1130 - DNA, 121 bp, Ctenocephalides felis
aacgcaatctaatgcctaagttctcaagtggcgcaaaaccacgtacattcttttttgtaagancacatgtatgttatattataaataaaagagggaaatctaaccnnnnnaaaatnnnaaa

SEQ ID NO: 1131 - DNA, 500 bp, Ctenocephalides felis
aattcaccnctntttaangggcctaataattatctccttttttagagcctggggataatttacctcttaattttggggcccctttagctttaattggctcaaagctcctgccatgtcagaaaatcttcctggttaaaaaaatatggaaactggtaattttatgtcgatttgnttggggtttggtatcatatattacacgtnaaacagacaaactctgngatattatgaaggggtatttttttataatatgcttagataaatctttattactcccattataaaagtttggttgttcaacaaaactttcaaaccagcttgccgcttttaggtttaccntttaaaaaaaatataccccntttattaatcactgggggtatttaactttaatggattattaatctncatatacatttttagactttgcttcactttagtaggggtttatccccttccatcnctntnttgcgggggntgaacttttatcatttnttccttcgggg

SEQ ID NO: 1132 - DNA, 129 bp, Ctenocephalides felis
aatttggtttttnggagcctctttttanagcccatttccagaacattttttagtaacctggtgggaaaactgatcgacaccacttntgaatttggtaaaaaacatttggaaatccctcttacttccggg

SEQ ID NO: 1133 - DNA, 398 bp, Ctenocephalides felis
taatcttaaaccttaatattggtttattaccgaaaatttctcaaatataataaccattcaacttattaaccgtcacttattaaacttttgntcatcaattggaatgtctacagaacaccagcgtgttttataatgaatacaaaaacgcggaacagacaaaaataaatctaaattgcattattatgtttataatgtatcttagaacatcaaagatataaaacctttctaaatattaaattgaaaaaatatgaatagccatgatataagggtaaatagatgtccaaaaaaaacgtttcatttaagaaagtcatatgagtagattagattttaaatttgtgcacagaatttatgactcatgatctttttaatcgctattcataaaataaacggnaaaatgt

SEQ ID NO: 1134 - DNA, 327 bp, Ctenocephalides felis
attgttctcttacaaatctaaaaattagaactaatctatgatataaataaaaaataggcagcatacttatacacaatgtatctaatacaatatgtattacttcacgattgttgtcatataaacttcaatacccagaattttttttgcagttgttcaaaattacaaattgtctgcacaatccatagatcggagtgttttcggaatggctcttttcccacttagattcctttacgtaaacacaacacaaagcgtgtggagcaaaagttttcgataatactgcattatattgaatatatctgntaatgttccaaatcatgtaggttgcag

SEQ ID NO: 1135 - DNA, 357 bp, Ctenocephalides felis
cacacagtcagtgatagagttacgcgttcgttccgcacttaaccttacgaatacttagattttctccaagaaaatcttttatctaagaagaaaccaaattcaagttgatgcattattctccggaattgttagagaatctgaacaacggttcgttgttcttcagctacgaatacaaccggcactgtaaagggtctttgaagaaactggctcgaaagctgctccacgttaggacggccgttctgaagattgggaacaagtnaagattaccaggaaaggggaacgatgatgaccangaacagaattttaccgatnttaccaacgnnttnngacatatgtnnacatattatacaaatatat

SEQ ID NO: 1136 - DNA, 500 bp, Ctenocephalides felis
ttttttttttttttttttgntttggaatacataatttggtttacatttattcttttataaaattacataaaatatctttaggaataacaaaaagggattttcatatgcacatgtgcatataaataccatgcatatatgtatatgcatgttaacagaaaaattggnaattagttaattagttcactgggacattattttttccccacgtttgaaagaggcacttcatttcctaaaaccggaaagngattttcaaatgagtgggcaacacatgatgctttaaatcggcacgcaaaagtcttgatgacatgtggcacacatctcaatcttgcatttgatttttcactttggataaaaatatagtataattcctgntgcttgcagatatcgggcagtaagcaagccactctgggaagatttcatcaaaatcttgcccaagctttatgccatgacataaatgatgcctgataaaatccttcctaatattggtcctcagaagctgc

SEQ ID NO: 1137 - DNA, 378 bp, Ctenocephalides felis
ttgaaatttataaatatatattttcataatctatcattttataattcttaaaattattgagctacattatcaaataatttctctgcaggtaacttccaatgttcaaacacataaggtaaacgatctttttgttcagtgctccaatgatgtattctgcatttaacatctactttttctttattattaattgttacaacaacattgaactctttattttgcaagttcatatccggacctttgataggctgttcgggtatttttattgcttctaatgggcactcaattccacctttacgcagagctatttgaatgtgccatggctcgataacccaaggctcttctttgttcattactacggcaaatacatgtttggagagt

SEQ ID NO: 1138 - DNA, 264 bp, Ctenocephalides felis; identical to SEQ ID NO: 207

SEQ ID NO: 1139 - DNA, 498 bp, Ctenocephalides felis
gtttttgttattttcggaaacttggattaataatgaagaacgaattaatattcagaactattactgcgttactcaatacaaacgatcggactcaagagcaggtggtgtagctgtctaatgtctattattcatgttcagatactcttcataatgcgactcctatgcagtttcttgcgccaacgatattactggatatttctaatgaaattacacaagtaggtgatattacacacacagaatcaaacattgattatagtcgtcctttacatttctcccaataaaaacatatcaaatattattaaatttcttcatcagcagttacttcatttttcttatgagggtgcaaaacttttaaacactaatcacaacgagataccattaattcttgctggagatttcaatgtcaattttcgttcagaagaatctcaaccattaattgattttttaaataataaatttaatttaacaatgaataattctccatttgaatcaaccaca

SEQ ID NO: 1140 - DNA, 498 bp, Ctenocephalides felis
taccgtcggtgtttattgaatttttagttatttaatcagaagtaatttaagaaatatatacaaaaattgaattttatcagaaaacatataccatttcataacaagttttatcgcgttcgacaattttcatataatgaattaataaatattttcaaaatgacatcagaaatttttctcttatcacctgtcgatcgcaattaaaaaaacactgttagccataatattgcaacagaggaatttatccagcacatgcttatttataaagatcagcttatcaataacatgatatatgaaaatatacttacctaaatgataatctattgtttaaatgcatttttatatttcaaaattcttatttaatattttcgctttcgtatagcagataaaatcttctggaaatttgcaaaatggaatcgatcaaaaaatcgttgntttacagggaatgcacagcaattaatgccattattaatggaaatgatcctatttaagcaggaacac

SEQ ID NO: 1141 - DNA, 289 bp, Ctenocephalides felis
catancaattatgaaatggattcatgatatatatatatatttatcttcaaaacatagacattcaaaactatttgttctcattaataagattacattcagtcaagaaaaacatgccaccgagttttagctttttcaacaaaatataatttttttttattgttaaaaaacaactgccatacaaatacaaattcaaacacattcattacaacattatgagaataagtttaggatttaaccagaaataaattaataatggcgaacaaatagtaataaataacttaaaatcagt

SEQ ID NO: 1142 - DNA, 484 bp, Ctenocephalides felis
ttttttttttttttttttttcggtttacaaaatttatttattcgtcagaaaagaaatttataaatttacttttttgataaaatctgngtttgtaaaaaagngttagtgtatattcaatcatacaggnaattaattctgttttttttcagtaaccttttcttaaaactttctaaaacttttcaatttttaacattttcaatattttgntactcatttatttttatcatttcattttgattattggcatatttctatatattattttttcaacaatgttattaatttaaaaaatccatcatcttataattttcctaaacatattgntngcttaaatcttatcaaaatcatgtttcttgacagatgtcctgaagttggaacatacctagttccgaaacgcgataataaataaataaagaaatgggtnttgattattttattactttttggattctttggcgaagctcaacaatatatatatatatct

SEQ ID NO: 1143 - DNA, 498 bp, Ctenocephalides felis
aaaatattcgaaacatttacagttacttaagaataaatttacttatgagtaaacatagttcaaaatatttaatgttatttataattataaaataattgatttttagccaatcgtcgaaataaaaaaagacaaataaataaaaatatnctttataaaatacgttttgacacggattgtgtgtcatctatcagcaatttttgttaaatagtatctaaaataataattacaaagtttaaaaaataaatataaaattttatatttaaaataaggnatacataccacactagaaaaaaacattttttaacttcccgtaaggnagttatgtnatgaaccgaaaatcgaaaatgaaattttttgcatttctcgacgtcttgaaggtttctggacattttggcatacctcagaaaaaatggatgtgtgtgtgtgtgtgtgttttgtatgccgcatttttagtcaacgttttcgggcgcacagatcaaccgatttgaatgggttaaa

SEQ ID NO: 1144 - DNA, 500 bp, Ctenocephalides felis
ttttnttnnntttttntttnnttttgnannnttaaccacgccatntcggcaagccatggnntacagcaaatgagtaaacacacagncaaggcatggaaacatattatgtngctgngtgtngcatctcgaataaacccaacgattggacccaaagccaatgtcattattccttgcaagaacatgaacagcccgtatgccgaaggaaatctctcctgtgaaaaatattcggcaaatactaaaggtaaaggcacatgaatccatgtgcggaagaatcccaaaaaacttgatattataagcatcattgtaaagtcagtcacgtacaagaacactatacgtgcgaaaactgagaataaagctcccgctaaaaatactgttctactgctgactttaacacaagcagtcattcctgccaaaaacatccttgatgacaaatctgcagctgctgcagcagacacacaaattgctgtatcagttttgccagcctaatgcaaacagataca

SEQ ID NO: 1145 - DNA, 280 bp, Ctenocephalides felis
gtttaagccnttaggtttaagnccctngttagcgcggtcgcgggccggggtacatttaatgntacaccttgagggaatgacgcttgcaacagccttagaagcacccggatattttgtagaaggtaaatcacaaatctgaacatttctttcatagacgcaaagctggtattcggtttcaatagccgaactctttggttttaatttttgaatcttaaagtattgcccaggcgtagcccacccatcattaatatctaattctaatgattttgcaatacgatgt

SEQ ID NO: 1146 - DNA, 287 bp, Ctenocephalides felis
tttcactggcctaccaaatttactacgccacctagtggcggccaattgtccttcatattcctctttgatggtttttgactcaaattcttgcaaagcacacatcaaagnttttctttnatcggatgttagtctcaaggggagctcgattgcttgttccttacttatttttccatttgaagggnatgatgagngattaacaagactgggaggtattcgnctctcacantttggtgntataatagcagcatgtaaaaatttggaacgactgtgctgggaaagaacacaat

SEQ ID NO: 1147 - DNA, 484 bp, Ctenocephalides felis
ttgctagttgaccatccatcagcattattgagattgttttgaaaaaaaaaaaaaagtcaatttaggttaatttataatttttgctctttaacaaattgtttatttatattgtagtatttgttttaaatataacttgtgccagattcttcttttctaaaacgaattgatataattttatagatatatttagaaatattgnttttgggcatggagggtaaaagtaattgcgtttgaatggaaaaaatgggtctttgtatatatggaacttgatttttatgttttgtgaccctaaaaagaaatcttcctgagagaatcaatttcttctttgctccacaaatgtaacacacatcacacagggtctgtacaaacatcgggaaatatatgactatatatatttctatcattttcatactttttatactaaacatttatatttggnnaagaatgnatgatttattattatataaatgctaaaatatttatg

SEQ ID NO: 1148 - DNA, 498 bp, Ctenocephalides felis; identical to SEQ ID NO: 520

SEQ ID NO: 1149 - DNA, 306 bp, Ctenocephalides felis
taaaattgttgagcataaaatacttccaaagtctactctccaatgtaatctacaggatcaacattcatttataaagatttaatgtttcgagtgcttcgtataatagaacacctataaaaacttttttttgatattcgtgttgatactatataaatttttaaaatcttattttattaattcactcatacttttagcacagatttaatactgcaaaaatttcaatacaaatttattatatacagatacaacaatccagcttgtcactactctcactctaaataactacatgactatcaacctctctgt

SEQ ID NO: 1150 - DNA, 500 bp, Ctenocephalides felis
ctcaattaaaacaaattttgtgctcataactaaagatttttctggagttgcggnccattagctcatagaaataaattattgacagcaattttgttcaattatatgtcaaaaaaattatgtttctatctaatcattattgaatgttaatgtaaatggnttaattttttaatgcatgaatatttccaataaaacatatttttgaatgtgaagatagnttatggcatataaattggaccattattnctatggncaatatttgaaaatattaaaataattttaatgcttattatnctgnaaactattaagaacnttnctgggcccngaatatncttttnaaaaacatttggttattcnaaattattaagaatnaaaacgtgttgntttcagacntgaaaggtacnatttctaacntctggnttggcacngaacnataatttgnttaaggcccacatttaaaatcntnacaaaacntctcacncnnanttttttattattcatca

SEQ ID NO: 1151 - DNA, 349 bp, Ctenocephalides felis
agaaacagatagtagtcaaatgagtttccccctgcaatagtcgccagaacgaggggaaatatatgcttagctattaaaatattcattataattaaaagggtttgttaactttattttaagagttaaattagaagtggcttcagaccttcgtaattttataaacactatgatctgtaagcataaatcagtagtaaatggtttactaaacttcctaaatgcacaaacaattgctcaaaaatatcattgttaaagcattgaactatgtctaaaatattgcaaaagaaattaacatattttaaatattactaagaacaccatgtattctgcatcagatgtttatcttttttgt

SEQ ID NO: 1152 - DNA, 396 bp, Ctenocephalides felis; identical to SEQ ID NO: 387

SEQ ID NO: 1153 - DNA, 500 bp, Ctenocephalides felis
tnttttttttttttttttttttttttcaagcangtcatcaaaaaattttattaaatttcggnnatngncatantaaatatgtaatatcacctcaatttcagntataaaaataatagccaactgttatcattcanaagnattatttngccttctgactcctttaaatcttgttcttgacttaaacgttgttctgnagcccgttcccatgcatattnaaatggaaanactaangggttattttcctctgggccgttngcgccatctcgaccttatgggcnggagntcccttcatatgcaatcgntctaatatggnggggnatgaacaacggaatcaaaagaagttatntacgagaatntttccttatcagatttcacatccgggcgcccttttgntgaaaaaagaacttatgtttgccaatctctnttaaaaactcaaagcacttggatnttctgggccgattgntgggcacatctattaaccaacatttatttttgtcctc

SEQ ID NO: 1154 - DNA, 314 bp, Ctenocephalides felis
aaatatttggtttctgtttataaaagactaatacaaaccatttaatcattcattnnaaaataaaacattcataatatttaagttgncaggtgaaaactaattgcataattatttaactaaattattgactgttttatttttcgtttgattttgtgctgaaatgatgcaaaaagaataattttgagcaaaacctacctctttttaatttggaaactatagagggnattattaatgnttccaattccatagaatgtatatttgtagattagtaaaggtaattaatgccnaaaaaaaaaaaaaaaaaaaaaaaaaaa

SEQ ID NO: 1155 - DNA, 352 bp, Ctenocephalides felis
atggctacattaaaaatcaaacgattcaatgttttttatgaattgagaaaacaatttatataaaaacgattaactttcattcagaagtttttgttaatataacaatagtatctgaaaaatattaaaaacatctgtcaaaaatatgcaaagtaatttcattcaattataaaaagatttttcaataatttacaaaaattaaaaacatttttgaaaagatatcaatatcagcacatgttaaatagtaagagacaagaaacatgacctttaaaatttaatccgtgttgcatatacaacaatgtattttaaactgtgattttggcaaccatcacttcatttattgcatacgtaatgt

SEQ ID NO: 1156 - DNA, 500 bp, Ctenocephalides felis
ctantnagccccttactnacncttggannnccgcggncgtccggcggtcctggncaaattggagttattcgatgtcttatgtagagnattttgaagngggtaaataaataatacatcggctcgcgagnttgttaaagtttgattaaataacttagtgatcattttcaagttattgaattacaacactttgaaagcattaagtgcctttgttagattttaacaatatcaacataataaataattatattaaaaaatttattttaattcactcattttaaacaaaataaatttcatatacaatatttaataaatcctgacaaaattgtatttaatttacttgatattttaaataataaatgttttagttagaatattaaggaaacgtatacattaaaataaaatgatatgttcttcacctttatcttttcaataatacgaaattcgaattagtatggcttccgcttaaattaaatatgtttgctaaactgccaatcaagaaa

SEQ ID NO: 1157 - DNA, 92 bp, Ctenocephalides felis
caaacgaattacaacaagtggaaaccactgtaataacaaacgaaaagtgctacgaattgnctcaattcgntgaaccaacttcgcaaatatgt

SEQ ID NO: 1158 - DNA, 495 bp, Ctenocephalides felis
ttttttttttttttttntttttcaagggaaaagactttatnaaaatanggngattttatantcngtatncaacnctgattacnantgttccattacttttataaaatntnagaaacaattnacgctngnatnaacaatttaacttcaactttgggagcagtttcaanagcagccaacaaatngtctacattacagcaatatgngtatcctctagttaaattagcaaaataggaatcttcaaatccagcttntttgcagangtccttgcagagtanatctttatgaggaactttntntgcataaggattattgagggtaanaaaagcaangccttctccagtttttggcgatngtactattttccaattccatttgggtatccaaatgtttccgtntttggcaataaacatttttacttcgttgttattgcatcaggcagagttaggatatnatggacacctgaatagacggncaaatcttcagctntggaagaan

SEQ ID NO: 1159 - DNA, 148 bp, Ctenocephalides felis
atgaaattatgtgttttgaaatttttccgattttgtaaataagacatgcttttgttttgatattttaaatgtgttcattgggattactggctttttttacaaactcatatgcttgatacgcatatacatacacataatttgcacatgt

SEQ ID NO: 1160 - DNA, 339 bp, Ctenocephalides felis
cattctagagtatttggggaaagaagattgttcgataaatcaacaattttagacaaacgagaaattaagtaatattataaaaatagatatcaatctttcatcttactaatttgatattgataaaaaacgaagcaatacatagggtgtgtggttgaggcgtttctttttttgttttatagtagatgaattctaaaacatccagaaaaataatatatataaatcagttaaaaaaatgttttttttcgcctattcagtatcacaatatcccaacaatgcaatatatggttggcacccattcaaaactaaagtatgacaagacgcatagccaattgaaaatgt

SEQ ID NO: 1161 - DNA, 212 bp, Ctenocephalides felis
aagctctttacaccatcatcaacttttgttttgcagatgtaatagaaatgatcatctcctggccatgggccgttttctccagctctttggcagtctactgcgagattcttgcaaatctcggaatccaagcttgaagtgcacgtaccagttacgacatcgaatgcatttttaccaacgcattcttttaatattccatcagctcctttttcagt

SEQ ID NO: 1162 - DNA, 498 bp, Ctenocephalides felis
ttaaaacaaagaaaattagttcaaatatttttcaattcttagtttgtgtgtgcatatattgattatttagaaatctttataaacaataggacacttacatttcaaaaataggtgttaccgaataaattatgatctctttcactacatatattacaatcaacatttattaaataagtgntgaatttatttattgngcaaataataatatgctntncatgtttgnaatcaatttattaatttaattgnataatttgntggtttaccncacattttagctactggtgagctaggcataatgngaaanggatatcttaatttttttgngatcaaagctttcattttattaaaaaaggaanttattaataaatatgngccanttttcantattgggatgctanttatgccnatgatatggtggnatcatnatatttgaataatcgattttttgatcctnttgngcgatatttaccaacnntaatgttttaagctntaaagaat

SEQ ID NO: 1163 - DNA, 360 bp, Ctenocephalides felis
tccnaagcccttgtnggctncatttngnttaacgggggcnncggcgggggactaaaattgntgagcataaaatacttccaaaggctactctncnatggaatctacaggatcaacattcatttataaagatttaatggttcgagggnttngtatnatanaacncctatnaaaacttttttttgntantcggggtgntactatataaanttttaaaaacttattttattaattcactcatacttttagcaccanaatttaatactgcgaaaatttcaatacanatttattttatacagatacancaatccagcttgnngctactctcactctnaataactacatgantattaancnctctgt

SEQ ID NO: 1164 - DNA, 500 bp, Ctenocephalides felis
cgagtatgaatatgattcaaagggaatcaaaaataacaaagataaagtttcattaaaagaagctattttactcatggagaaaatgcaaaataaaatggatgattccagcactgtgctcagcgatctggacgatgatcttttggaagctgaaattttgcagtctgcaaatgcaggaagtcatgaaagcattttcaaaggtcgctatcactacgtgtggcctatgttgcttctccttttaattgttcttaccgttttgtttgtcgttggaaaaatagttcacatttgcaccgataaccgacaacgttcactcaaatatcagaatataataactgctgtgaatcacaagattgtaaagaagaaggattgtggattagtatatcaacctctatcagaagaaatcagatgtccccaacgccaatagtgacacgctatcaagctatttgagcagccgtttcatcatgaaaaaatacccccgacaagtgtactttaaacgttaattc

SEQ ID NO: 1165 - DNA, 495 bp, Ctenocephalides felis
tttttttttnctnttttttngatgaattaacattagtcaatttttttattnnaaaaaatataatatgagatttccgattacaaattatttttgttttttctttgatgttgatggtttattggctttaaatttagatattattgnagttatcaaaacaagactgaatcctatagttgtaaatgcgataacaccaaatattacnatagatcaacgatggngtattcatttatgagtgnggtaaatttatcaacagcatcacgaatcatttccactacccaggaaactagatcatcaaatggtgcttttggtagtggcacaggttcagctttagtatttttgtcaagcccnntttttttttttttttttttttttgcttgnngggttattagantatggatttgtcatctataaaacnaatagttaanaaaaattttttaaggtcaatttccacgangcaattttncacaacatcattaatttttccaatctggattc

SEQ ID NO: 1166 - DNA, 419 bp, Ctenocephalides felis
cagcaccattagcacaaacagacaaccggcatgagttatccaatcgcttgcgattctatgctctggtaaaaaatataagtcgagaagttgccatatgcttctccaaacattgacagttccaatgaaactaaaaaatagaaataagtcagcaactaaaactctccaaaatccttccaaacgagcacatgtncatcgcatgataggctgaagactgaatgtgagtattacaatcccgtagccaagtgcaagtgaagccagagcactaagcgatggatcatctggaaatataatattgtccaatatcacccaagctcccctncacacgacaaccaccaaggatccaacgatgaatacggaaaataagcaatcgattaccgtaaagccatttcttntgatgctcgattctttaaaatatgtag

SEQ ID NO: 1167 - DNA, 293 bp, Ctenocephalides felis
tagcccttcaatcattatttttatttaataattgggcagatttgntagaacaaaaataatgattgttagggctataaaatctgcacaattattaaataaaaaaatattgggaaaattttctatatcatgggcaatttattacagaagagcgaagttaagcatgagggntttatcaattattggtctataaattataatagaaatgaaaaaaattgttagatataaagaaatgtttactgtaagattttagcaagtgttgagttgaaaatgaagaatatgcttacaaaattggt

SEQ ID NO: 1168 - DNA, 109 bp, Ctenocephalides felis
caatcaagacctttggaaagatttttggggcannttaggttggcccaaatccaagaggaaattcaacgttggccaagcgcctttncctacatcagcgggcaaatctggt

SEQ ID NO: 1169 - DNA, 438 bp, Ctenocephalides felis
tgagaataaagctcccgctaaaaatactgttctactgctgactttaacacaagcagtcattcctgccaaaaacatccttgatgacaaatctgcagcagctgcggcagatacacaaattgctgtatcagtctttgaccagcctaatgcaaacagatacattgtttgaatagcagaaaaatgctatgtcggagtatagtgcaaatgtcactccaataaccatatttacataaatccagtcttttaacaaagtcaaatccaaaaagtcaacgataacttgcaattttcccctggatttcttctctaccggtgcagtagtgctatcactgacaatgactgctccagtccaattacctaaactagaaatggaagatccacgtcttctcattctatgttcttcatattgaagcatcttaactggagttacgccttctatatncc

SEQ ID NO: 1170 - DNA, 500 bp, Ctenocephalides felis
ttttttataaatngtttaaaaattacatattattgaacaaaaaataaactgtagtaaattaaaaacaagatccaaatttccaaagcaatttgttaatcaataactgagaaacgactcgtcgattattgacaaaatttaatcagcacgattttcaaatagaaaacttttttaatggtttttgaattttcaaaatcgattcacaaatgtaagctataacgtgaacaaaaaatttgagatttttttgaaaattctaaagaaacggctcggccgatcatgaggcaaaactaaccagcacgagtgcttatcgaatttgcgaatttcaacgacttttcagataggattttgcattattaagaaaacgtcgactaaagatgaaatttagactcacgtaaaaaagtgctgctcatttttttggaaatttttatatttttctgttgattagaaacagcttggccgtcgcgcacaaaactaaaagacgctagtaattatctagtacatca

SEQ ID NO: 1171 - DNA, 220 bp, Ctenocephalides felis
tctcaaggtctggtgagacgttccacaaaaattctagaaatcagaacaatgcttccaaaatacaaatacacgtcctacaatatcaccattcaacacctccaacaattttactatatcatttactcctcaaaattcgtcctagtaggcttataaacaccgacatccttgtcctccgaatggtagcccaaggaggccaattcgtccataacctcaacattgt

SEQ ID NO: 1172 - DNA, 284 bp, Ctenocephalides felis
aataattttaactatgtcttattatatccctttgtgcatataggggntaaactgactaacaagtatcacttttttttataaatatccaagtatcatacgacacacgtttataacgatttcataaattaaatatcactgtttgtttttgtacaaaggcactttttgtcttcaagcacacaccgaggctttaaactaccaatgtaatatttgactagaataattttaattgtttcagcgtccactgaaggctttaagcaacttcgtgccaaacagactctctgtcg

SEQ ID NO: 1173 - DNA, 500 bp, Ctenocephalides felis
ctaagatgtatatattctacacatatgtgcatataatattgtcaagtaatgtcatgtgatatatctccaaaaggcgtaaacgctggaagaaaactgagtaaactagaaaaccattgatgtgtggaagatctagtccaagaagcttttttatggtataaaatggaaacaaaaatgtaaaaatatagttgcaattataataatcatatcattagatatgtagcgaatatgagatagattctttttaaaacttttataaatttatttatatataaaaattctcaatataaatagtatactcaaatatatttatatgatttaataatattgaagtttttataaccaatatttttcagtaaaattttcagtaaatgatgattttttttataaaagtgcgtattaattaaaataatataaaaaaaaaagattttaaataatcaatatactattaaatatatgatcatttttatgaagtattaattttcttataaattattagataa

SEQ ID NO: 1174 - DNA, 353 bp, Ctenocephalides felis
cttcattttttcaatatgcanttcgattttaatctaagggaaaaaatntncnggtgtnggttaanatttaattnggaataaaattctgtgtattatatttagttttttttaaattatcatttaatnttaattattgntaaaaatatnatncgattaattaaaataatattaaacataaatttcattgntttttttangaaactaaattgggaacctttttatatcttattatcnacgctaaaaaaaatacattttttttagtattttaccgtttcatattatattaanaaaaacttttagttaatactaattattataaaaataactaaaagttnnacaaaaatactggaagt

SEQ ID NO: 1175 - DNA, 500 bp, Ctenocephalides felis
tttgtnannaaagatacaggctgtttgtttatattgcataggtatacaagtgaagcaatattttgaacattgaaaaaatcacaaattgggtatataatttacagnaaaaatacaatatagttcagaattcataaattaatattttntacaagaaacaattactttaggngcttaataataagtttcttaatgaggcatgaagatataaaattaaataaaaatgatcatagngnaaaatacaaattaaatagttcacacaaataaatagttagcaaagtcatctacgctatatatacccttaatactcgtatattcttctagtagtaattttttcactaatttcacagncttcaagattattccaaaagatttacgacgaaccatctgatgtgagcgaatttgatgtagagctcagtcgatctccgtatttattaagaaggctaatatgacaccattcgtncagccaaaaccaagctggcctcatattntccgcatttctg

SEQ ID NO: 1176 - DNA, 299 bp, Ctenocephalides felis
ttggcaatgaaatacagttgggaaaggactaaatcggcttcggtgctaaggcttaagctctanaaattctttcccattttgggatttttcccggggacaaaggcagaaaaacttggtaaattcaccggggaattttaaatggtagaagcaaaacatccaactcttggaacccggagataccaccacctccagaaaatacgtctgcaggtaacgtcattgttccacaaacggaaactgatttaaatattcaaaaatcataaaagcggtcatagntttattaatgagttggaaataattgt

SEQ ID NO: 1177 - DNA, 230 bp, Ctenocephalides felis
aggtgagcgtttggtgaatcctgaagcatnctgttcatagcaacagctgattgggatatcagcctgcgctgtccggactggaccatggtgctcttgacgagcaatcctacacatctcatngccataacgaaatacgaaaattattagtgaaccttcgaaaaatcaggaaccccgttgtaaatgatagatggacacacacaacgcgcgtttgaaatgaccgacactgtngt

SEQ ID NO: 1178 - DNA, 318 bp, Ctenocephalides felis
ggcaacanctttgccttgggcaccggctgctgctttggcagcataactcctgctgttcgataaaatcgatgcgattttacccgattctgttttgctcagggttcgcaaagtggaattgattacggagtgcatcttgtaataaaatgtatagccagttgagttgaattaaattgatctcacctgtaagctactgaacgaagaatattaaatcctttatgagcactgatagtattttttggagtgtgcttacgtaacttctgcacttttcagtttcattgcttgnaacattttcttgaggagcgggtaattcggcatggt

SEQ ID NO: 1179 - DNA, 329 bp, Ctenocephalides felis
tgtagccaccgcgatacgaatcggaacgcccatgcttatcatccatgtttctggatagctgactcacaaactaacttcaatggaaccccaactcacacgtcaaggattttgattaaatacacgtgcaaatttgaataatcaaaattaaacttgtcttataataaatgttccacacatttgncctnctgcatntgnaggtatgatgatattgaactggcacgagtgcacttaaaatagttgcattataatattaattcgttgcacttgaaaatttaatgctgaaatgncgaaatagtccacacagcctacaagcacgtaacacacgtnaa

SEQ ID NO: 1180 - DNA, 190 bp, Ctenocephalides felis
ttatattanagggncgtgttgaggtaactgncggaaaagaaaatttantctttgagagtggtccatttacttattttggtcttcaagcgattacacaaaacattggagttgccgattctgngaaaggatctatgcaatcgttaaatatagatggtatattaaaaaacagttttataccagactatacagt

SEQ ID NO: 1181 - DNA, 305 bp, Ctenocephalides felis
cgttacttccaaccatttttgcaataattttaactatgtcttattatatccctttgtgcatatagggtttaaactgactaacaagtatcacttttttttataaatatccaagtatcatacgacacacgtttataacgatttcataaattaaatatcactgnttgtttttgtacaaaggcactttttgtcttcaagcacacacgaggctttaaactaccaatgtaatatttgactagaataattttaattgtttcagcgtccactgaaggctttaagcaacttcgtgccaaacagactctttgtcg

SEQ ID NO: 1182 - DNA, 58 bp, Ctenocephalides felis
tacgatttagccgaggcaaataaaaattctattgnaaacccanagtggaagcaaatgt

SEQ ID NO: 1183 - DNA, 383 bp, Ctenocephalides felis
agngggctaatataggatctttataattaccgnagggccaaattagnngacaaaatnnaactgagatttgtaataaagattgcaaacattttcaaaaaaaaaaaaaaaattgaaaattttacgatttttttcggaggagggtaattttcaatatacggtttcacagaggggaaaggggatttcaaaaattttcaaaaaaatcgattacgtgattaagtgacgtcccgagcacaaaacttatgggtccaaatatatttaaaatnttaaaagtccaaatgtccaaaatctgtattacaaatctgtcagtctttttgcaatcctttatcaaatattattttccatcaaagcacacacttttttatacatgcattttccaaatacgt

SEQ ID NO: 1184 - DNA, 500 bp, Ctenocephalides felis
tttttttttttttttttttttcacataatatacatttattttcaatttaattaacngggaaatgctattncataaatataacgtattntaacatacaaaaatcaaaacatatttatnctactaagtttatnctgttngcaacagttgtcttaccttaaagtaaaaactgggggccctgccctatatacactgngtctatttactgattacaatcacatctgacaatcccaatcacaattnantntaatcnccanctcatttatttaatttataatcaatatgcctggatttgaatttaaattcaatnggaaaaccaatcagatnggtngcacacataaatatactattttgtattttatcgacatgaagagataagttatatttttagatcaccactgacttttttacttttgattaagtctcaaatttatattatatatttaaatattggtttataatactgaatatttgatgtgngaatattattaagccaaaagatt

SEQ ID NO: 1185 - DNA, 327 bp, Ctenocephalides felis
cttctactctatcgcctctgaagaaagaccaatctttaataggctcgatgaagatttttttcttggcatcaagaggtgaattatcttgtcggaattcttgagaccatggtcggtgagctccgaagtagaacttcctttttttgatttctttcctcgaataattcggtttgttaggagttttccaatatacttgttccatgcttcgcttaatgtagttttctggcaaattggaatattgttttgttaaatcgccaaccttttggcataattgcaaagatctcctcatgtttgaaattatttacacaaaatcaatgacagaataatagt

SEQ ID NO: 1186 - DNA, 498 bp, Ctenocephalides felis
atataagtaaacaccaaaataatccattggggttccaatagattatattcataattaatattacttacacgtagttatatttttattggtaggaagtagtgatcattaaagttcaatttgaaaaaatatcaatttttttttatcaaatgctgngtatggaattatatatacaatttcatttataaatttgccaaatactaatttataggtgattatattttctattctgcccatcacaaataaatgaattcttttttatattccctccatttgcttttagattcagtagtaatcactacttctatcaataatcaatgcatatccctaattaagagagnagattcaaatatcattttattaattctaaagaggattcttatgttgatcgatattttaacatgntgaaaggaaaactgaacgacttgctcctttatattctcattttaatagcagantgntttttgaattaggtataatatctatatttatgcnaaataa

SEQ ID NO: 1187 - DNA, 496 bp, Ctenocephalides felis
aagcngaaaaaatatgaaaaatatgtaaactgnaataataataaatattataattattgggcaattaatattaattataaaactattattatatttctagaagcaaaatttttttttccttaaagatgtttttttgtagcatgtgtatttcattcaatttacaattattatgaaggagaaaaactgtcgaatatggagtcacgttttactttaaaatttcaataaagtattttaataaataacatgtttaatgaatttaatatttttccatttattatacacagagagaatgctttatattcaaagatttatgttttaaaatcatttttcataaagggtttcatatacgacttttatattctaaatcattaatttttgggatttttataataattaataaaacaaatttattcagtacccnacntcagtatttaaaaattattaacaaggatatgcttatattaatcaaatgngagtgggnaattatttgcncaaa

SEQ ID NO: 1188 - DNA, 448 bp, Ctenocephalides felis
ccgggcgggggaccagaagtttacttacataacttgngngggnaacttattccaaaaagatgngnttacgggngnatatagnagaataagatttaatatgtnatattacatggnacttaatttttaattgnatatcaatctttagtataagcaagactacgagggccgtattttaatgnatattaaaaatgatgngnataatcattatttctatttaattcaaaagagtatatatttgnaatatctatatttaaacaaatattattaaaataatcatatataaattatacagcattctattttattcaatggcatgagcattcaggacgtaaagngattaacagggttcgatcaaaatagaattctatagttttggtctaaaagaaacgaaattttaaaaaaattatgttattcngngggtttattacagctattaaattttttacct

SEQ ID NO: 1189 - DNA, 117 bp, Ctenocephalides felis
cgnacgccctcttaancnccttaaaangccctcgagcgggccgnccgggcacggactttnaaantacaaattnacggnattgttataaactaacagaattgacagttttataattgt

SEQ ID NO: 1190 - DNA, 213 bp, Ctenocephalides felis
caacaacaatttcnaaacaaaatggctgganggataaaacggntaaaaaanggtattcaatnggattggnttttggtaccggtaatnccctaaagggaggcaggggcggtactttttctttntgggcggtgggtggacttnggcccaatggtcaatttcggttatttnccaaacttcaaggcttttgaaactttggcattcaaaggacaaagt

SEQ ID NO: 1191 - DNA, 207 bp, Ctenocephalides felis
cgctatcacagcaaaagaaccagccatgattgccgaagtgtcggtgactctcatgtgattcatataatcagctttgtgttgcttgtgatgatggtgcttgttgaattgttcttcatgttcattagattcacgatcctggtgaattggttgaaccaactcggctccaaaatcaggcgacgaagaagagctttcctgaatcctctccgt

SEQ ID NO: 1192 - DNA, 330 bp, Ctenocephalides felis
agggantagtaaagggaaattagngcccattgataccaaaacaaaagaattnggtctggctttaatttcaacaaaaaaatggttggggttantggagggaatgaaaaaaattcactggaattaaatggcggtctanttccctcacccatttcaacaaggggatcaacgaaaggggtgggcaatngttttcaagccgcatnccaagttnattttagtaggaatcaagcccctcaagcggatnccctaccttcttaattttgcttgcaagggtattgaaaccgggttttaagcttggcccattgnaccgggtctttggctaaccaaaaaagt

SEQ ID NO: 1193 - DNA, 149 bp, Ctenocephalides felis
ataaaacaaacaccccgattataaaatatnaaaatatgtaccatatcattaggttaagnatgtaaatagcgctcgaaaattatttattaataaaacattcttaaaataattgattgcaattatgaattcattaacgatatttgttatgt

SEQ ID NO: 1194 - DNA, 342 bp, Ctenocephalides felis
aaaatggcattatatgcnnattataggctgagcctttataaatctgtgnatgaaccanaccactctatcttctaacctaaagtgtaattttgttttacagaatttctttaataggtaatatttttaattgcagngtatcatattatagtttgtaggtgttatattttatttgtaaattgntgttcatatttctcaaacgattgtttatgtattacacagtattaaaataaaccttggatgcaataattgttataacaacattgttgttagtaataaaattttatcaatggattattaaaaaaaaaaaaaaaaaanannaaanaaaaaaaaaaaaaaaaaaaa

SEQ ID NO: 1195 - DNA, 131 bp, Ctenocephalides felis
atgatggcattcatgacgacttctgtcgtnnaacaggcattttttgttcacaaatcctgnncagtaaatcataaatataacgaaactatttgtagaaacctttctcagtataaagacatcaacaccaaagt

SEQ ID NO: 1196 - DNA, 463 bp, Ctenocephalides felis
gtgcagtttttaattgngaattaaatatatgttgatttaatttttgngnaaactgangagcgtttatttaaaatcaatattaaactaacattgctaaggtgatcttaaatggtgaaatgttcattatcatattaaatttcaattcaacgtatctacttcatcaaaataaataattttattggtgacttcaaattatcaatatacctccttcaaattataaatatacctcaattttttttcacatgccgtgcagtgccgtttgaaaattgtaagttacatgcttttgttgatttgtaattgaatcttttgatgtcttggaaaacttttattgntacacataaaggatgaattataaatcaatggaagcatgtaatgattgcattacacatattcgcctcatatatattaagtatattttggtggtaattcttgcacttattggttaatattttattcaaatatg

SEQ ID NO: 1197 - DNA, 252 bp, Ctenocephalides felis
ngntcttcaacnttgctctccaangccctnnagcggncgnncggggacgtttttttttaactgntaaaatatttattataaaaatacaaaacaaatttcataaaatatncattacaatttgngaccaaaaaaattaataattccctgttgcatcaatattgccttacaaaaaatttccacgaatgaaaatttatattatattctatttaaacacttattaactattatttttagttcaagctaatgtaacgg

SEQ ID NO: 1198 - DNA, 444 bp, Ctenocephalides felis
aacaaaaaataaaaaataacccattttactggattcatttgaataataaatatgttngtctgnatgggttttttcttaaaaaaaataaccaatatctacaattgtctttgacacaatatattaataacagacactaacatagtatttgaaataacatagtattaatatttgtattaaggcactcaatactataggaatacttggaacgcgcattgctaaattcctcgcttatccaaaatacgtataaatacttattatcaattataggggcatattgctaaatgacttaaaatcaataaaaagcgaatctcgcgtataaaaaaatgccatcatcatatctcactgtgtgnaaaaatattaaaaatttgatcacgatgattttgctgatcacaacttatgctagactcacaatatgtgaattaaacatgagctctcttatatttg

SEQ ID NO: 1199 - DNA, 498 bp, Ctenocephalides felis
attattcataagacatcaaagactttattacataagggacaacatagtaattaaagttacagaaacaatgcagagtcaatacttcgattgcttataggaattcatggaggtcgaagaaatttctagtatatttttgatttcaaattttaatactcagttaatggtatgaatgctaagtctctctctactttattcatatatgacaatattgcacatttgtgcacgaaaccttgagttgaatttttcagagatagttatgcatgaaatgttgaataccagtatttgctccaacggccttcctgcatgcgtctatatggaagctatgaactcattttaaagttgaagattttatggaattaattataagagcataatgactctgagtttgaggaacttgcttatgtttaactaaatcatttgcaacaacatttaaagtcggaactgttcacaactggaaacaggatatctgcatttataatactttaataataattgcat

SEQ ID NO: 1200 - DNA, 226 bp, Ctenocephalides felis
ttaaatatttatatgatatttctctacgatgtttaataaaaaaaaaattgattgttttgaacttgaaatgtagatttggaatatctgcacgactgttattaatttaaaaagttcaaagattgtttattcaataaggaacatattaaatatcatattgttaaatttttatatattgatctattgtaatctatctctgtgattaacatttaccaattaaaattggagt

SEQ ID NO: 1201 - DNA, 228 bp, Ctenocephalides felis
agtatatagatagatagaaaataaatatagatattaaactgtgtttaattaaatattnacaacatataatttataaatatatgcttagaaaaatacttgtagcagcattaaaattaacatatcaagcatttgttttcataaaaattaaaaactgcttcatttatatgatgaaactatgatcgtaaggcttgcaggcgactctgcatttcttctaaatcttcttctggt

SEQ ID NO: 1202 - DNA, 70 bp, Ctenocephalides felis
acttagcgggcgccgtgcaagtgattcgaccaaagacggacaccgaagtagacgtggaactataactggt

SEQ ID NO: 1203 - DNA, 114 bp, Ctenocephalides felis
ggcgcaacccttttggcgactgcctcacctgccttcttagtgagtttcttaagattatttctctttttgatgttaagaatagtcttaactctcctcttgttttcaagagtacgt

SEQ ID NO: 1204 - DNA, 337 bp, Ctenocephalides felis
gaatactggttcataaaatttagaagccctnntttttcgcctacggcggtatggngttccgattngtgtccgggcttgtccaaaaatgtaaaatccacacgcgcatcttccaaaggcgtcaattcatgtaaaacattcggtaaccttaacanttgtgttactaaattctcctgcacgggttgaaaacaatccttaagcattttaaatcatcccttacanttttaccctggntgattaatttagtaaattccgtcaccggatttgtcgagtgtttaactttatcggcgatgctggttctgcacgcgttcaattttcggcgtgttttgtcaaatcttgg

SEQ ID NO: 1205 - DNA, 445 bp, Ctenocephalides felis
aaatatggcccaaacaaaatattgctttttctctaattgngctttttaatgaagaatcatacataagtatgaataatttcctaactaatattgctttatcattgatttctttgaaatcagtgtctttaaagnttcctatttcacttccatttggcataggaagttcactgcaacgagaaatcaaacttatacctacacaagctgcttcaataatcattggtttagaggacataacatgttgtaacaatgcatttactgcaattgtataagtattgctttcaatcagnttactagaatccctttttgaaatttgtattctacgttcacatgcattgctaaatgctaatatcagcccatgtttgttttcatcagatatgttagctgattttgattgcgttatcatagactgaatttctttttcaaattcaaatgctttcatagtggt

SEQ ID NO: 1206 - DNA, 383 bp, Ctenocephalides felis
catataactgtatgaacagtactatataaatgatgcgtgtattataatttcgagttaaaacattttatttgtgattatacttgtgatttaatatacaatatctattttaagttatgacatgttaccgactcaaaaaagttgatatattgaatttttatataatttaaactatttgtgaagagatttaatacttctatttatgtataattgtaaataataaatacagtattaatttgttgtataatagaagatattataagtatatttagaagcattgattattaattctcttaagcgttcttatcttttaaactgttatcacatttctaaatgtttaataaataaaccagttgaaaaaaaaaaaaanaaanaaaaaaaaaaaa

SEQ ID NO: 1207 - DNA, 350 bp, Ctenocephalides felis
caacgacgacgacggagatgccaaccacggaaatactcgactacaaccacagaagaaccaaccaccaccacgaagtcaacaacgacaacgagcaatacaccaactccaggatttccaaattgggtgctataattggcaagtgataagataatatccactattcaaataactattaatgttaaaaaaaaattcagtattataaagaacacaaacaatattaataataagttattctttatattcagtaacagtattaattctgnttgtttatgtcgttgtaaaaattatacaaataaattaatttggaaatatgaacaaaaaaaaaaaaaaaaaaaaaaaaaaaaaaaaaa

SEQ ID NO: 1208 - DNA, 147 bp, Ctenocephalides felis
attaactacttttgatgcataaaaagctgcagaagagtgcactaatcgattatgttgaggccacttcattaacacctttgttctaggtatgttatatacctctggtttggctagtcttagaacgcattgtttgtgtgaggctttagt

SEQ ID NO: 1209 - DNA, 304 bp, Ctenocephalides felis
caacttttaatgatattcaacttcaaactcacgtggctaatattttccaagttgatagaagtaaaattaaaataactcatacacctgaaacttcagtaactattctctcttgatttcagtattaaaatataataacaaaaagtgataatgtaattttgttcatgagtttttgctgaaatgatctgaatatttacctgttttcgaattaccaaacattgaaaagttaaaaataaaaaatatttattactttaatttattttagcatatgaacaattcatattgttaacttataataaataatagt

SEQ ID NO: 1210 - DNA, 498 bp, Ctenocephalides felis
aaaaggagaagtttctaaagacnatttttnttntacatgtacctagtgagtgtgngggggggaaattgctattgcatattacatacaagcttaataaaggttatggtgatttatttcatttaaaggcaangtatcggnttaatggcnntaaatntatnttttatttaatattaaatagattaattaaaaatctataaagtgataagaggcctgatatccataatattattgaatattaagaagtgacggatagatctgataatgtagtagttgttatagacaatttacttaataattatgagttgcatcattatgcaatgatttatcactattatttattcaacattttatttaactgcttgcaacttttaataaaacgcatnttttattgttttaagtataaatcttattagggcacaatatgaaaataaaaataaagaactttatacaaaagctnttttatcaatatgcttcttgcgctattaagttaagaaattt

SEQ ID NO: 1211 - DNA, 342 bp, Ctenocephalides felis
caatgacagaaaaacctcgtattgntatcactaaaaattcaattccaacaagtgatctggcttatactaggcgccaagaaaaaaaggcgaacaatgtagatattattcgtaagaacagcgacacttcgaataaaactgactcgtaagaattttgtgaaaagtgtttgtgaaagtattattttgtcaaaaggacgatttaggctatgtagtgactgtatggttaagaactatattagaacttattgctcataaatccaaacatacaataatctttataaaaatcttaataatttattaaatatttttacataaaaaataaaaatagtaaaaacgcaaaaaaaa

SEQ ID NO: 1212 - DNA, 487 bp, Ctenocephalides felis
tgaacttcattatttaaatttaatcanagnntattttttaaacaaaacatagtagcggngtaatataaaaaatacatttatataacacattaagtttaaaaaataaaagaaagcaaactacaaaacaaagtttaaatttttcaaaatcaaaaaccgtagaataagtatcaattataagaatttttttattgcttttttaatatttttatataacttacatgtaataatacatttctttatcatagaaactttttatacatgctattattatctatatgtaaaagattgtgcaaaaatatttgagtaaattttcaaatcaaaataatacgaaacttataatcaagcggttaatgtaatttttttttgtctttttcgacattattatcttaactgtttttaagacttagtttgtgtttctcaatctccaaaataatttatcaccatgaaatatctcttatcatatatttttaaacttaattctataggt

SEQ ID NO: 1213 - DNA, 236 bp, Ctenocephalides felis
atctgagatacagcgattagtaattgntngccagctacttaaagagtatgctgcatanttatttatacgctatataattatatcttttatattaaattttgataaagaagtgaatataaaaaagattaaatttaattacaagcgtataattgtatattgtttgatttacaccaataaaagcanatcagtaagttgagttnctttaaaaaaaaaaaannaaaaaaaaaaaaaaaann

SEQ ID NO: 1214 - DNA, 379 bp, Ctenocephalides felis
gggggttntaagaaacncnnntttgacccaccnnttttttanggggccccccggccgggacnagttgtataaaacataaattgtaagtnntcttacaggcacatgctattgncttattgnatntatttgttctaccaggaaagngctttatagattttactaaatatatattaagaaaagcgttctctgttgaattgtaattaatcctttttgtaagatttacagcangtatgaagaaatgttaaattttgttaaatttcatgtattgnatatgatattcgcacgtacttatgaaatgtatgtcagtcaaatgctgaatttattttaatatacaatctttgnaatacaacnnanaaaaaaaaaaanaaaaaaaaaaaaa

SEQ ID NO: 1215 - DNA, 498 bp, Ctenocephalides felis
ataaacaagcagaaataaatatagctgctatacatatttctgcttgtttatgtaccgancagagtggtaacagaagatactcanatattttaaatgtaggttttccaagcccatccaatgttcccagcaaatcaaatattgacccaatcaatttaagctacagtggaaatcaaatacttactacctcaaccagcccccgaagcacatttagctatagcaatgcactccgtggtcagactactcaacgcccctttaatagaaacacaaatataccaaataatgaccgattttggcctcaactaccccaaagaggaccacaatccggtgacaatactcaatttagttctagcggtgtttcaaatataaatccaagtcaaataaatactcacaatcaaaatgtaagaccacagagtgcaaataataatagaccattcagttacagtagtattgngggtgcatccaataataatctgccaatctgtactcctcaacaactaa

SEQ ID NO: 1216 - DNA, 343 bp, Ctenocephalides felis
caatgacagaaaaacctcgtattgntatcactaaaaattcaattccaacaagtgatctggcttatactaggcgccaagaaaaaaaggcgaacaatgtagatattattcgtaagaacagcgacacttcgaataaaactgactcgtaagaattttgtgaaaagtgtttgtgaaagtattattttgtcaaaaggacgatttangctatgtagtgactgtatggttaagaactatattagaacttattgctcataaatccaaacatacaataatctttataaaaatacttaataatttattaaatatttttacataaaaaataaaaatagtaaaaacgcaaaaaaaa

SEQ ID NO: 1217 - DNA, 498 bp, Ctenocephalides felis
catatgtagaaataccaatcaattngntgattacatcaaaaatatcaaatgttnaattgaacttttctttgaaaaatatcgatgaactaactattgatttgccacaaatcatatcgcaaacatttggaaatgtgcagaaaactgcaaatcttataccagaaaaagacgaaacaacantttcagataaacaacaaaattttgctaatgaagatttgtatgatccagagaagtttgaccaaatgccaggtccttggcccgttgacctaccattgcctatgccttgttggggaagagaaactgatgcaaagttagatttttcatcagtaatagaatatgaggcatttgccagcagagtagaaatgacggaacagagattattggaagagaccaactatgatactgtagataactttttacaattcagccaggaatatagaaaaatgagggatgcttccgaacaaattatgacctggataaattcttncgtgcttatcacca

SEQ ID NO: 1218 - DNA, 420 bp, Ctenocephalides felis
ccnaannttaatccctgttgatatagcatcacgaaatgctccccattggaaactgcccactgngtatactggctttgcttctttggttatctcttcttcagaatttacttggtctgcaagtagttttatttgcattacgtctctgtaagtttcttttccttgtaaaacagccatggcagattttgctaaagcagaaactcgttttattccactttcagacgctccaggaaacatttcggatcctacattactacatctgcctaacggcaaaaccccaatgggacaagttgcaccatctggtcggcgtaacattcctgtaacagtttcagctaatgttccatcacctccagcaacaagtaaagcgtctggtaatgtaggcatttcctctataatttttctagcgcttccttctgcagttgt

SEQ ID NO: 1219 - DNA, 183 bp, Ctenocephalides felis
caattatctagtgaaaaaatgtctcgattttttttgcacgtgactcaataatctagagtcaataggtaaatagctatttccactgaccagaaatttcatttcaattgacttagctcttatttccgtattttaaacaagtttcaataaacttaagacagttttaatatttctgttttgccgggt

SEQ ID NO: 1220 - DNA, 500 bp, Ctenocephalides felis
cctgcaaaatggtaggactgctcaatattgttttattagcttttgcatctgttaacttttctttgtaattctcaattctccataccatgtgccccgttccattaaccggttcactcaaagccttatggaaggcccttgcatcttctgcatcttttatctgntgtgacaattgcgccaccaatctctcttgtttaaccaattgccgacttaatttatccaaaatatctgtattatcttgaactgtgcttttcatagatttcaattcgtataaaaaagaagctattcgagctttttgtttgtccaactcgtctgccgttttcgtatgatcttcataaaagttggaagccacttctcgtctcgttttttgggcatctttttgtaattgtattactgattgcgtatgaganccatgtcttgtctaactcatttactcttgcgaagtttttatcctgccgttaatacgacctcgacttgggttcttggtttcttcatctagtatc

SEQ ID NO: 1221 - DNA, 498 bp, Ctenocephalides felis
aaactacaaactacaaaataattaagatcattatatgaatcacataattgtataactaaaaactgcattttatcataaaaattgntataatttttttttataaataataattattattattatcctgaaaaattttgagaattgacaatttccatacattatgccactgaatcataccgaattctgtcaaaatatcatgtatttgctgtgcattcaggcgttttacacataaactgcaaccgtcaatcgtatgttatgaagctgagtcagaaagaccatgttatataacatcgttttttgacgtttgtgtggtttctgggtttttatgtgataacttgagaaatcgcctgactgcagagcaaccgcatggcttttgcaatattcagtatggaaagntgtcgtatcatagccttgcataacataagtctgttatgcggccgaatcggccattaatattaaattttgatgtgatttttagaataaaatatgctcagtgtt

SEQ ID NO: 1222 - DNA, 402 bp, Ctenocephalides felis
ccgnaagggtacanaaattgataaagctaaaaaggacttattcaagaaaattactagtcagttaattgggccgtagtattagtgagttattcagaaaggaagtaaaaattgcaaatctccctttactcattgtgccaaagccagaacaacaagctctcgttgactcaacaaatgatgtnggattaataaaactgtttgatcgaaagtaaattgttataaaaacatctgaacacataatcaatatctattgattaaattttgtatgaatgagacattagcatttaaagtatttatctctaacgcattttctacttaatgtagataactattctttgggaaccaaatctattggttacaataaatatttctaagtgttaaaaaaaaaaaaaaaaaaaaaaaaaa

SEQ ID NO: 1223 - DNA, 207 bp, Ctenocephalides felis
aaatgatattaactttataatttttttttataaaaagccaaaattttctcacgtgcgccaaaaattgtgctacaaaagtaaaacatctggtgcttaacatatttttgttcaagcactaaaaatagtgtttaatttgaccttaaccactttggtttatatttagcaaaaatttattaaaagcgatataaataatattgataattaagt

SEQ ID NO: 1224 - DNA, 427 bp, Ctenocephalides felis
tcatacattgcaactgatgtagacatatattcaagcatacataaatactccttcacaaaataaatacaagatcgatctactaataattgttacattttaatatatatcgctatttactgtttgtaacaacttaagataattcattttcttctatttgagaaagaaaatgatcaaacattttgcaaagaatattaaaatataattatatcacgaaaaagttttattcatggaatcaaaagttattcaaaatgtcaactatttaaaaactaaattaacaattacattcaattttgatacagttattaaagtaacatcaataaattttgaatacgcatttacatgaatagtttcttaaattttgaaatgaaaactgacaattatttaattcaggctaatcttacatttgcaatataataatcactacaag

SEQ ID NO: 1225 - DNA, 263 bp, Ctenocephalides felis; identical to SEQ ID NO: 211

SEQ ID NO: 1226 - DNA, 295 bp, Ctenocephalides felis
tggttagggcccncccccggacaaaccacaantattaaattagaggagaggtttttttagtaaaaaaaaaaaaaantaaagggcaagggtgaaaggtgggatgcactttcttaaataaannnactgntaaataaagnttatatttatattaaattacaattaggactacataatgcactttaaaaattatggcatagttaagacttcattagaaatacaataagctacaattataaattggattatatttnggatttttatcataaaagaataaaatcattcagaatgcaaaaaa

SEQ ID NO: 1227 - DNA, 335 bp, Ctenocephalides felis
ctggcacttccccaataaaaaacgccannnaaacctaaaaataggnaattaaataagactgggnagcagtgatgatagcggagctgtgtctcctgatacaactacaacaatttctcctttaaagaatgctgcagataaaactgngaagactaattaattttaatgccagataaacttgatttttgatatacatatgttggtatgtagttatgaatttaatatactttaattaaacccattccaaaaatcataattcatattttttaaatttgatttaagaaatcttaatgtgtaactttattttgtttttatttagagctgnaaagttttattgn

SEQ ID NO: 1228 - DNA, 225 bp, Ctenocephalides felis
caaagggttnaaaaggtccggnaacaatcgtttttttttcnaaaataaaaggantgtnaangggnggggntattgggangaaaaaaagtanaagaaccccaanntattggccccgcaaataatgcatgtgaataccttatntcataaatggcgggnctatgggctttgggcacaaaaatggctatcaagntacatgtcctgnaacaagnctaaggngctttcgna

SEQ ID NO: 1229 - DNA, 435 bp, Ctenocephalides felis
tctttaaaanagagttngggttaaattcattggactnttcaagaaatgcacaggcttgngggggnggtgaaaaccagcggtaaacttggaaaaaaatattttggatacaaagttaaacgtgctgatcctgaattaaaaaaaggntgngataaaacctgtcttaaaaatcatatgtgtgcaatagttaccacagntgtatcagatctcatccagtgcaaaaatatcatcaaatcatcatcaagcattcttcagcatttgaatatatatgtcctaggagctattgtaatttccaattatttattattataaagtcatttttgttaagttattataaatttagaataaatcattatgttggaaatatgtaaacgctttgaaaaagctaggatcaaatcaaatattttttgaaaaaaaaaaannnaaaaaaaaaaaaaa

SEQ ID NO: 1230 - DNA, 282 bp, Ctenocephalides felis
ttttatattacatagatnttttcttttatgtttttgtaagctttgaaaaaacaattngtttttcatatatattttatacacaagaatgtcctgtatgcttatttttttaatccaacgaaataaaagaacaaataaacgtaaaaaataactacattatgaaccccaataaaatataatactcctgtgtaacgcgggatgtcgngttcccattgtaattttatgtaaatatgtataatttgaaagctcgtatattgcttgttctattttcttgtatataaatgt

SEQ ID NO: 1231 - DNA, 101 bp, Ctenocephalides felis
cattcaaaagatatcatttaaatttattgggaaattaactataataataataattgatttatttcttaaagctattaacccattattttcaaattgcatgt

SEQ ID NO: 1232 - DNA, 224 bp, Ctenocephalides felis
ggttgaaccgttcaagtattttataagtgatgtctctgattgtgtatttttcaaggcacttgattttatgttcattgttttaatatcaatgtgccttctcggtagtatataaattttacatagtaaatcctgtttttgattttatcgcacattttttgtgttgttttaaattaattttacaagagaccatcacttataagctgtaattttactaaaactaaagt

SEQ ID NO: 1233 - DNA, 347 bp, Ctenocephalides felis
caactgttgaagatgagaagaaaccagttaccaacggaactttaccaaagattgaagaaaagtgtgacagcgttgcagaccttaatggatccataaataaatctttagatcatctaaagccaccagaagtagcagttgctgatatcaacacctgtattccagaaaagaataaagactttttatgtggtatcagagaaagtcagctcttanatcatgaactgcagtgggactccatggaagacaaggaatccaggcagaacgatgatgcagagtcggaccatagcgaagaagacgacttgggtgaattgccggtaagaaccgtattggatcagtatgcacctctaggt

SEQ ID NO: 1234 - DNA, 498 bp, Ctenocephalides felis
tataactataataatggggcaattctgcttcataacacatagttgtcatggcaacgcgtagtgaagacttcgaaaacgttaagctatttgccgtgcgatcaggcgtnttttacatataaacatagcaagaaagaatgttatgaaaacagcatcataagattcttctttgcttgtttatatgtaaaataaatgtagacattttnatattgccatgacaacgttatattatgagctctgttacgccagaattgccccataagtttaaatattcttcaatnatctttctccattggtngaaaaatattttatttacagtnntagcacagtcttgtgaatctatttgcgaattctacattttaataataaatataaaaacanctgaccgccatccgcatactagaagaaacattccaatctgatacctcattccatttgntcaaaatnaaaaataaaattacagncgactgatttattcctgggtgcttaaaaaaaatccnt

SEQ ID NO: 1235 - DNA, 337 bp, Ctenocephalides felis
ttttataagcagaaccaccaggtgaaagataaacgttccaggatcctgcattattgaaaactttcagaaaattaccagataatttattttgtatacaaaacgngtctgtatatgcagcagcctggatggaagatggtaacttttgtattagtttggnaacttntttcttttcatntggntgaaaattggatcgatnatacacttttttgacgcgttgcacaaaagtgaaaaaatcatcgtaattattggttngcaataaatcattcactacaaataacccatgaatgctcagtggtnagttactgntgnaactaacaaaatctatgagagaaagtgt

SEQ ID NO: 1236 - DNA, 351 bp, Ctenocephalides felis
taaccccttanggattcccttccgngccngaannnggttaacgnggncggcgggccgagggtccatcctagggcgaaaatttttaatatagaaataaaatgaggtcgccttctttttgaaaacccattttgttctttgntaagcagnatcggcaggtgaaacataaacctgncaggatcctttataattaactttcaaataattatcagactctttatttcgtatacaaaatgtgtnccgtataagcagcagcctgaacagaagaaggnaaacttttgtattagtttggtaactttttgcttttcatcagggtgaagatttgaatattnatatgttcctctgacatgtcgn

SEQ ID NO: 1237 - DNA, 156 bp, Ctenocephalides felis
aaagccagcgatagnatagaactgctatgtttncctccaaataccactgttgttttatcatntaaaaatgccataagtatggagctaatgcatccaatcaccatcaatatatatatatatgaagagtcttttatccttcctgggtaaagnttctgt

SEQ ID NO: 1238 - DNA, 347 bp, Ctenocephalides felis
ttncttnttttttntntttctttttntttattcngnataaggggggnataattcatagnttatcttacaaattacaaacatgaagtcaagccgnttgatccaatatgaanattggtggatataaatatcgatgatccaaatacaagtctgntgntcaaaccttcaagngatataatacaaaaattatgctggaatgctttgggtaggaactcttatcccgattaaaatgacgagataaaaataaaaacagcaaatatgcntaaaatgaggatgatgtagatgaaataaagatgnnnatattaattaatgatgttaatgaacacttttcttagaagcacttcctgtgt

SEQ ID NO: 1239 - DNA, 598 bp, Ctenocephalides felis
tataatataangtntttagtattaaatggnttgagaaactaatttagttaagttgtatacantaaantataatcgngnganantatgtttatatttacaaancctcgagatggagnttaangttagatgaatatattaaaatgtatgntctaacaatngtaatattaatgtnaattttaacccggaaattaaggaaaacatngctttgatgactacttagcttccgatccagaggtgatttagacatttagttagcattttaaaatattgtgtagctaacatttcgngtgattttgcaactaatcagttatttaagaaatgtgcatataattattatatacatattatnttacatacctggntagnattcaaaaaacttgncaattacttcgccaaaagaacattggggggataataatatcatattatgcaacattctttattacgggnagtttacttgaaggatctggtttcttgctntttttcatttgatcagaaaataatcaaatctacagtatttgggtagcagtntncgaaaattaacnggnttaccatattaaaaaatttntataattcannacccggtttgggaaaaaan

SEQ ID NO: 1240 - DNA, 446 bp, Ctenocephalides felis
ttgaaattttatgtgtnattatatttattatgttagtaaacaagtgaaaccgctgctataaagnattgtttaatctgaatgtttatatatattgtattttcaagattatcggcactatggtatttcttacaacattcatactatacaattataaaaatatatgcantttttgnntgnntacatattggnggataacccacaaataatatgaaatggaaaaaaaaatgtaaaccggngacacaaaatactggagacaattattataacangggatattcaacttttaaantttcatcaatagntttttatganctcgcttttgaaggattcattcatttattcaatccaatgncnaatcataaatttattggnntttaggggcactactatattggattaataaganaaacaacttngttatgaaaaaattcaantaaaaccatgnn

SEQ ID NO: 1241 - DNA, 274 bp, Ctenocephalides felis
tttaagtctaaaagaaatccaagcttttttatctcaaagtatcaattttgattttaaggtgatttaattattttatataattatatataaagaaactgttttacaatcagtgaatatttccacaaaattattaaaactatataaatataatacaagtccatcataggtatgactacttttgacgaaatattcataattttgaccaactaccctctttcataattttgaccatattatcaagttaacccaaacttatcttaaatatgcgatatgt

SEQ ID NO: 1242 - DNA, 102 bp, Ctenocephalides felis
tttggatccattcattttatttacaacttactatgtaatgtaaattaaatgtgaatgngattattataataagtgaaaatgtttgttattcaatcacattgt

SEQ ID NO: 1243 - DNA, 193 bp, Ctenocephalides felis
ttcaaaatatacaaattcgtatatgttatttattntatatcaccaatttatacataagcatgggnaaaattcttacagaattactgaaacataagataaaatatgttcaaaaatatgattgacgtatcactggcagctttgtaatattaatattgaacgatatgccaattgcaattgcgaaatatattatagt

SEQ ID NO: 1244 - DNA, 498 bp, Ctenocephalides felis
atcgaaatagtcttcagcatcatcgactgtnaccacacaaggtggtgctgatatgttngtcagcgttttgagtaatcccaaaagtaaaaccgctgataatgtaactgctatgatcaattggagagatctatcttgatataagtttcctactaaccaagcacctcgccatgaattcacacatataaatccataaacagcggtgtagacccacgaagatagtgcaaaacatgtgttagatttaccttctaaatatcttttgatcggtccttgtgccaagcaaaatataaacatcccaataaagcctatggccaaagacacgaaactgctatatatttcattatctgtataaacataatgtcccattagattccacgtgcctctccaatacccgactacggcgggcgcaaccagtgttagagcaaatagagcatccaaaacatcaagaataactgatgatttcaaaggattcatagtcatcaatgatcaccggaaggtctc

SEQ ID NO: 1245 - DNA, 112 bp, Ctenocephalides felis
ttttttttttttttttttataaaataatcttttattccaaacgtttcgacattcaatttnggngtcatcatcagtggatattgaacatagtattttatatctaaaaatgtgt

SEQ ID NO: 1246 - DNA, 379 bp, Ctenocephalides felis
aaccgttggcaaatatcaacttccacatcatcancaaatgttttatcccaatcaggcgatgaatccaaatgattgaattcattacactgttcaggctgagtgtaaaataatgatgttggactttgaggcggagtaaaatgatttagttccactttatcataaatgcgttcaaattctcgtaaaagactctcagtgtcttgttgaataaaatctgtggtatcaaattgctgaggaaatttggtttctccgcttagagttttgttcataccagttgtagtagacaaatcctccagcagaggcaaatccactttctcctccagccattgagaaaatgcttcattagtaaagttatcttccagcaagcacgaatcagcaaagt

SEQ ID NO: 1247 - DNA, 230 bp, Ctenocephalides felis
ccttgctgaaactnctcctgatatgggcgatttttttattaaagcaagcgaaaaaaaatnnggnaatgaatgnctcagtaatcttaatgccgaagcacaagaaaaatttgccaatagagtcaacattataatcaaacaagccaaaagtaaagggtttgtttaacataatacaaaatagcaattagaaggtttagaaaggnttaataataactaattttgtacctcggacg

SEQ ID NO: 1248 - DNA, 498 bp, Ctenocephalides felis
catctattaattccagtatggtgcttncttgcaacaacatcctggataggaagtcttctgattcaacctccgcgtctaaattcataagtccactttttccatctttaggattagttaaattcgataacaagatttttaaaaacatctgtaattcaagtaaatcactaataaaaaaatctctatgtgctggctcgtcaagaatacttaaggcttcaaacccaacagcaaccgatgattggtcaatttcattagcatcatctccagcaataanatcaatcttgaactccttttcttctattttatcattaaaatatgcaaacataatttcttcttcagtttgactatcatcaaatgccacttcatagggcagcttatctaaaacaacacgcttcggttccttgcagtgtatgaattgataaacggtcgtgttaccaaattcaagaatatgtctaacaaccgtctagtcctacctttacatttcttttatttttgaatcct

SEQ ID NO: 1249 - DNA, 290 bp, Ctenocephalides felis
agtatcagtaggagtgttatgtgcaaatttntaaatcgngtatataaaatatatatggtatagattaaatgaatcagaacaatcttaagagccacaaggtgtatggcatctagaggataccgagaggatactaaaacgaaatgatagatttaaaaagtgtttccaccttatatgtcttcaaaatatgtaaataaaaacatcttgaataaaataatttctcaatgttngtctgaaattgaaagttgtgattaaagttatagttactagatgaaaaaaaaaaaaaaaaaaaa

SEQ ID NO: 1250 - DNA, 345 bp, Ctenocephalides felis
ttaaataagacaaagaaattcactccaccanttccctatactatccctttaaagccctttngncacttcaacgtccacatagntttccacagatggcgccacatagaaatcattgcttttttataatcgngttcgaaaaaatcttatcttattgttagtctattaattaagagttaagtttttgttaacttgtcaacttgttttcggttgttaatatttaaataaacaaatgaatgtaaaagtgactgacttgtcgattcaaattgttattacaaacaaatcagtcatttaactttgaacccagtcaattgttaaaatacatattataaacacatacacgtaagt

SEQ ID NO: 1251 - DNA, 498 bp, Ctenocephalides felis
ttaaaacaaagaaaattacnttcanatatttttttatncttagttcagngtgtgcatatattggttatttagaaatctttataaacaataggacacttacatttcaaaantaggtgttacgaataaattatnatctctttcactacatatattacaatcaacatttattaaatangngttgantttatttattgtgcaaataataatatgctttccatgntctgtaatcaactgattaanttacttgtatnangcagtngttttacctacacattttagctactggtaagctaggcataacgtgaaangtatatcttanctcgttttgacatcaaaagccttttcancttaatgnaaagaatggaaatttatgtaataaantangagcaccctttccaatcattggtgatgccctangntatgccctatganaatgttgtcatcataacnnttntganataatccgantttatatgaatcttntatatgtgcgaatat

SEQ ID NO: 1252 - DNA, 258 bp, Ctenocephalides felis
tcttccatcatggagaacatttggggtaaccntaatcttaaagtattcaaccccaataaaggcagaagttgtatagcacacacnatgatgcantttttcaaatgtggtgcataaaataaaggcttgaattgtttgaaaccagctttaagagcttccattccttcaggtttgggagaaccatcttgtncattggctttggtttctttcaccagtngttttattggatattcagtcttgtnattccaatgattaatcctg

SEQ ID NO: 1253 - DNA, 364 bp, Ctenocephalides felis
ttttttttttttgttcattttgtntgaacttaagnatatatnttnagggaaatttcaatttaaatnatccgcnatatatcatacatgtaaggcaataatacataatttaattaacgcattaaatttaactatgtaaattatgtanngntgatttatctacaatgtttttaacataatatatttaaaaattcatggaaaaatntatctaaanagctaaatatantaaaatggaaagcctgcgctntgctttagcatatttataaatagcatataataattnataatanatnctntanttagganatcattgataatcatttattcttgtattacgnnaatataatagtaaattacaaatgttngg

SEQ ID NO: 1254 - DNA, 318 bp, Ctenocephalides felis
cttaaaaaatcgccccacaatagttaaaggcanttggacgatagcaactaaataacataaanggtattatataaagattccaatcaattatcatcgtcaccgtcgtcgtcagccacaaagaagaaaaccaaccagtgactgatgatccaacacgatgatgatgatgatgatgatgatatgtatatatgtaatgttttacggtgttaatttactattatcggacgaatcaagattttatttattaagatatgggaaggtagtcacaaatattttttttnttaaatngatngtnncccattcccaaaccaaaccaaacca

SEQ ID NO: 1255 - DNA, 312 bp, Ctenocephalides felis
gtatttgttaaataaaaataagtcacatcttanttctgccaataatattaaaaatgcaacatntatccagatgcaactaactgaatatcactttcaacaactcaagacgtacagatgttacgataaaaaaacagcccacaataaatccttgttgcatattataaaatagatgcttccacattggtaataaggctaaataaaatccaacatcacccagaccaggatatgatttgaatatagcaattaaagctgcgagactcgttgctaataacataggctcatgtttgagacgaagagagagcggaagcaagt

SEQ ID NO: 1256 - DNA, 135 bp, Ctenocephalides felis
aaaaaaagttatactaaaaaaaatttacttgactgagcacttagtacaaaaaagttatactaaaaaaatttactcgactgagcacttagtacaaaaaagttatactaaaaaaatttactcgactgagcacttagt

SEQ ID NO: 1257 - DNA, 500 bp, Ctenocephalides felis
tcaaaaagcccttatacgattcgtatacacnttctttaaatgttcgctatatatttatnttccagtaatggttttaataaaattatgccgatctacattttctaaacatcggcaaaattaaatcacattataatgttaacctttcaaaaaaatactgtccaaaaagtatcacactttgatctacaaatgcaaaatggttgaaatcaagtgaagcaatgtcatttatacatcaaaagccaatttagagtcacttgtgttcacccactttgtttataacatcgtcaatcaaggcggataacaacagtgtttattgtaaataaattatttctaataaattgacaaaccatcgggtaacaaaacaaaaaagttaatactgcttttcagctttgtgatggttaatggttatgctcgaataaagcattgactgtgccatcaagaaagtatactngtttccattagtatttcgatttattccaattccaatcatattatcacaaata

SEQ ID NO: 1258 - DNA, 485 bp, Ctenocephalides felis
tacttttactttgtaaaatgtaaataataggantcactgagacttaaatgatccattggtattcatacaagttaatgatatctgtgaggtatttaacgagcaaaattattttgattcttaagaagtatgatgtttatagccttcttaagaagttatgatactgttatagccttcacactttgagaaagataatagaaattgttctcacataaatattactcattagcagtttaacttaaaaatgaaattcttattcaaatttgaataaaaaaaagttgcatcaaagtatcacagtatacaacaatattagaatcgatatcataaattgtgccaacattctgtgttgccactgatatcattattcatttgaaatatcaatggaattatcaactgaatagagaagtatttggctgagcttaatataatactaatagcgagatctgaaattaacaaagttgaaaactaaatagtattattttattagt

SEQ ID NO: 1259 - DNA, 232 bp, Ctenocephalides felis
tgtaaacagcactttgcctttgtaggttttatcgaaggcttcgctcaaggttttgatggctttggtgagttcagttttggctttgtcggtttcttcgggggatttgaaatttgttgctaagcggaagaagaataagctaggacgttcatcaggggttagttctaagactttgtcagataaaagcgttgaggacaccaggtctttcacaaacttctctggtaaatcactttgt

SEQ ID NO: 1260 - DNA, 371 bp, Ctenocephalides felis
tactttataaaaaaaaaaatcaaatctagaccaaccaatgatgagagtatagcgcagcaccattcaatggtaaaatttatattttagaaaaaattacttaaagaataatattgtattgctcttcagatttatcttcagaaatctaaatatattttgaaaatagcattgccaaaacattactagccaactatttcaatagtcagaaatgctattttcaaatatttaagcaatatgcaagttatttttttggaactgataagttcactcagtcaatttcccgatttataaggtttcaatatcatttgttaacttcacttaacttttaatctgtatatgaatattctgcatatctttctaatcatctttgaagt

SEQ ID NO: 1261 - DNA, 401 bp, Ctenocephalides felis
tatctgtttgatgaattactagttctgctttgttctctactggttccttcaaatttgaatatgtcaaatttggtgtanatcctagtgtgttattacttattccttgattgtttgaaatctcaataatttcgattttatccaaacttttgtcacagtcaaaatctggtaaaatctcttcataacgtttgtgaacataagaatcatgatcatcttttggtttataattaataatcgttctttggtttatttccttgtaagcaaaattattttttacaggcggcgtttcgacgtcgttatattttgcattgcttaaaaagcttgtatcgacaaaatccggaattgaatgagaatttaacgttgcgttgtgagatgaatttacaaaaggttgatacacactttgt

SEQ ID NO: 1262 - DNA, 498 bp, Ctenocephalides felis
catcaccgagaagaactcttcggctacggantntcttcattggaggcgcgttgttggtgcncgcagcattacttttggatttagaaataaattaattttggattaagaaaaaaaaaattaaacataaatataacgatctctctacaaacccatataagtnttcattttgattcttttagcctttaactttattttatatgaaaaactcatatttcttcctttgcatcggaggctttacatttagataaaagaaaacagattatttgacttatttaaagaaataattatanttcagaaaaagaatatttattacttttattatattcattaccgtttattatgattggttttaccgagccaaactgataataacatgcatgtatatgcttatatagtcgcacagttttttaacattatctattatttagtcgttaaattttaataacatttatttatttatataatttagcgccgcaatctctaatcaaaattacgtga

SEQ ID NO: 1263 - DNA, 452 bp, Ctenocephalides felis; identical to SEQ ID NO: 297

SEQ ID NO: 1264 - DNA, 490 bp, Ctenocephalides felis
tttttttttttttttttttttttttttctttactagatgtctttattcctaatcccaaaatattatatgtcgagngtcttcttttatcagaaggatcgacatccttcaatgcacttttctttccaaaaatgcttaatcttttagttcttaatttttcagagttatgagaatcatttaagtcactgttgattttttggttgatttcattaatactggctaaagatctgcgacgcatagaatccttttcggtatcatttagcaaatgaatgccatttggagattcgttaatatacaaagtagccattgttttggctttgaaatatcacttattgttatatatcacttattagtttacaataacactggtaaaacatagcattataagtttttggttcacattttcactcacaaacacgcggtcagtatccgcgcgagtattgtgaaagcaacagacgaaacactgcggttaaatgtcacacggtgttttcgt

SEQ ID NO: 1265 - DNA, 498 bp, Ctenocephalides felis
tctagagatattttagttgcagttctgactgtgattattttaatatgtcttactttacctgctgcatttataatttacaaatatggcatatacgactggatttgtagaaaagttaatggtaacagaatgctacctcgatatgaggatgtgatgatagggcaagaagatactgacgatgatcccttgccataagtgaatattataattttatattttcttgatctccttacaatgatgtagaatattgccttcaagtcatatgttgtaaatagttttacaaaatgataatgttatttatctattgaatatatgtatgtttatgtaatttatttaaatattaatttattaacagatgatgactagaagtcacaattgtgttattgaagttgttgcatgtaaatgaattatttttaaatagatatattcaaataacatgaaataaattttgtatttgtgattggtgaaagtgatggaaatattttgttgaatacaagcata

SEQ ID NO: 1266 - DNA, 311 bp, Ctenocephalides felis
aacaattctttgttttaatatcgatatataatcacgattttagtttatgatatctttatctgggctcattgtgaagatttcataccaaaatcgatattaaaatattgataacttcaataataactgtaatttccatagatatttgcaagataatcgataaatctatcaatattatcgataaatatattttcccccttttagtcgaaagtattatatagattctattaacacaaaaacacacagacacacaaattagtttaagtttagacgacattccggtgaaaaaaaaaaaaaaaaaaaaaaaaaaaaan

SEQ ID NO: 1267 - DNA, 453 bp, Ctenocephalides felis
ggccccgtaccggaagtgtgagctggcacatttgacttaacttcatttttatcttcatactcaattatattttcntttaccatttctccagcagaaggtgtcacattctgtgtttctaaatttgtattttgataatcatcactaaatctatttcgggatcgagaccgcgatctgcttcttctacctcttaattctttccttgtaacaaactccaaaaatccttcagaatctggcatcacaacaggttcttcaggttgtgaatccgcttcttgcacgcataattggaaaattggttgtgttttgggtgttccagctgaatgtttttcaaaaatattcgattccgtgatttgtggcacttgagaaggcaattcgctattagctttgataccaacaatagacgcccatgatgtcagttttggttggtcaagtagactcacatagcggttgttcagt

SEQ ID NO: 1268 - DNA, 498 bp, Ctenocephalides felis
caaaggggcaagcaccacctgggaaatttnnaaatgcagaattgatgaaaattccaaatttcttgcacttaacaccgcctgttataaaaagacagtgtgaggcgttaaaacagttttgcacacagtggccaaaaggtttagaatctgaagaaaaacaaaataaacattttcctgttacagtaattagttctgattattgtcacagcggtccgactataagaaatccattaggtagaattgttactttgaaggtcaaattatcggatttaccactagacaagcatgctcgggataagtttttacggttagttggtgacagacacgatcctgatacagatatattaacattagtagttgatagatgtccactgaggaaacaaaattatgactatggcatgtatttgctgacagctttgttccatgaatcttgggtcactgagccttgggaagcagataaatctgaggcggatatggaatattacgattggcaaaataatg

SEQ ID NO: 1269 - DNA, 285 bp, Ctenocephalides felis
tgctgctttctgctagtgaggtatttgctgtttctaatggagtatttgttgaagtattntggcttaagggttgtgattcggtgaggtttccattgctttcattcacgtttgaacttggagcagttgtggatgggcttatttcatcattcgttgactgtggttggtcgtctttaacgtcactgtctgggaaagcaatagtaaaagtatgattatgagtgaatatttatttgctcgactattattattatcttactaagcaaacgcctgggcccagggtcagtctgt

SEQ ID NO: 1270 - DNA, 498 bp, Ctenocephalides felis
tagagcctttccaaaaagttgttactgaggaagatttgataatgcgcctagaaatagtagcttgtgattcaacttgtgcaaatgtaagaccatgtgagctggctcttgttttattatgcacccaacttgatagctgtgtgtctcaattggaatctcatactgctcaaacgatgcttaaattggttgattttgctattcacatgcagaaacagtgcaggattcctgactccagcttcttcagttgtcacggttgtgttgtcaacatactgtcgaggtataacaatcaagataaaagtccacacaggcaaagacttgtttggaaattatcttcgcgcacattgaaacttcttcgaccaacagatcgtcttacatcacttctgcccactattgatgaaaatggatgtctaccaaggcttagaactggcagtgtgagttctgtgggcagtgaagatactgaagattggcccaccagtcctcttggtcccgttgtgagcaatg

SEQ ID NO: 1271 - DNA, 500 bp, Ctenocephalides felis
ccaancggttncanttggnnntnnnccnatttnnaattgnangggcccgggncntagggggtaantttaattggnatttgggcnttncatgacngngcantnagcttcntgacnanttctttttacacatatttttanaatgatcatatacatanttaggtgggcattcnaaaacctgacctttaccatctttgcagaanaagnatnttntgcnntcttttcgnatctggctgatatcctacaaccgccgcatgtannttctgccgtcttacagctttccccaggtttttgatgagcacatattattctacacaaaatgggaaccatttggaaatttgantccttcttcaaattgattgtangaaatttgggggtttctttgcncnaccccacaaactttaaaagnaaaaacaanctnnanaaaaaagntcccnacntggttattnaaatncnttgggcccgtaccncccttaaacccaattttgtnatantcnnnanaa

SEQ ID NO: 1272 - DNA, 157 bp, Ctenocephalides felis
tttttttttttttttttttttttttttngatnggtngaactttgtcactgantataatgtcttttgtcacttttattanaccaatatcagcatagttgacagtaatttttggngtatatttatgatgcatcacaaaacgttcgacgtcgtagtatgt

SEQ ID NO: 1273 - DNA, 235 bp, Ctenocephalides felis; identical to SEQ ID NO: 430

SEQ ID NO: 1274 - DNA, 400 bp, Ctenocephalides felis
acatcaagcataattttcaaaaatggtccaagaaaccgaatgcaaattaaatggatcctcaaaccccgaggaaactaatgtgattcacggtccagccgcgcctgccaacgaaggtttgaggggctttggagaggaaatttatgacagaatagttttacatggcgatagagtatccatgatcgacggagacaccgatcgctccaccaccttcgacgcccttcgggcacgcagtgcagcaatcgctctagccctaagggctcgtggagtgaccaacaaagacgtcataactttggtagaactcaccacagaagactcttttgccattgttttggggataattttctcaggagccactttagggatgttggatggagcctggacagtcccaaacactgctagt

SEQ ID NO: 1275 - DNA, 343 bp, Ctenocephalides felis
ccaggatataatttgtgagataattataaactattgtaaataaaacataatttaattattggaaaaaatatttgttaaatatttaggataagattgctcaagtcatacccaggatataatttgtgagataattataaattatattatctgctaccattaaacttaagttattgttaaacaaaactaataaattgtgtaagcaaacgtttttaattggtagactggtcaattttatgaaacaaaaataattaaaagtttggtaaagtttctgctaattttttttgctcaattgtaagcatgttaagtaaggtaggtgtctgttttaataaaaaaatgaaattgt

SEQ ID NO: 1276 - DNA, 204 bp, Ctenocephalides felis
ttacgaattgattttagagcattcaaatcggatgctctgttctctcaaaaacttaatttttattttctgcactctttgcttcgtatcttcgaaatagctggatcggcctttgccaaaaactaatcagcacatctccctatcaataggaatcgaatttttttttgaaccattcaaattggttgatccgtgcgtccgaaaacgtgt

SEQ ID NO: 1277 - DNA, 150 bp, Ctenocephalides felis
ttctatttgttgggttattttatttcagctatgaattatatatctttattatttaattaagttttttaataatctctttgaaaatattgataaaatgtaatagaaaatacaaaaattttttgaaatatttagcttcataaaaaattccgt

SEQ ID NO: 1278 - DNA, 337 bp, Ctenocephalides felis
ccnnttcgaaagtgttaacttatcggatgagcnnaagctttactaattgaattgattgctagagcttgnaaaaatattgcagcagaaataaattctcttaaagcgttagcttacatgttgaagttcantacctctcgataacaaaagaaaatgcnnactacgttaaaantattcaatttttttaaaaaaanntgggttgtttgctttctganntgtgctcgttgggggcccccctggcgtgggggccccgtatttttgatacngctgatacggnggtaagttacgcccctgatctgcattnatatacaaattttaatttaaaaaaaaaaaaaaaaaa

SEQ ID NO: 1279 - DNA, 549 bp, Ctenocephalides felis
aatttatagttgtgtaaaatatttttttaacaatcggttcaggaattaatgtaacgttcaataactaatacgctgacaagcggatcgatttaaaaaacgcttgggcacatatgatttttggattctaggaatcaaaataagatactttgctcaagaaaccatacgtntaaagtgaattctggttaatgaaacgttccgttttcacccatttcagctgatggtaaattggacaatgacactactagctctgaacaaaataccaaattaaagaccgtagaaaaatgcaagttacctgagaaactggaggcattaaccatcaaattgtaacaggagtagttaaaaattaaaaaaaaatgttatatctatctaagattttttgtgaaacgaaaatcgattatgatgaaactcagttgctcttgtatacttatgtcgattgatatacaattctgtacatacataatatgaaattatccaaatattaaacaagtgcaatttcaattaaaaataataacgcaatattcatgtcgcttcaagtcaattcattactga

SEQ ID NO: 1280 - DNA, 549 bp, Ctenocephalides felis
cgctgttttaatgagcggcgcgataaaataaatntgttgaatacatggctattttaaaaatcgtttttatatgaaaattaaataaacactatatattttgcgcttatattgaaacagaaaatactatagttcaatgagttttattaaaaatattgaattattttacatttggagataaataaaatggtttataattatatgatatacgcatgagtaattatgagtttgcgctaaatctcaatcaccactgtgtagattcagctttaacatagccaatccaactgtaaagagagaaggaataaatgataggataaatggcaggaaaggatcaacaaatgcgaccatacatatattccatcataataatgagacatacgtaaataataaggngagggaaatcataatgggattgagaacattaataaaattcaagaaaacttattaaaaattttcagtgtggtgtcttctgtcactctctacaaaggtagtaaatctgaggaggtcgtatcaaggataagaaatcactaagatgaggattttattgcaaat

SEQ ID NO: 1281 - DNA, 549 bp, Ctenocephalides felis
cgggttccgaagaagatgatcaaatgattttcgactctgatagtgatgatggccaaaaaacctcacaggaaaatatattaacaaaaaatactaacaaatggatggacagtttgccagcttttgtttttgaccctagcatagacgctaaacaaagatccaaattgatagaaaaggaaatgaatgaacaagcaaaaatcatccatgacttgagaacattgggtgcatctcaaggaactatagaacatgaaatgagaagactccatgaattggaaaccttaatttttaaagattttcgaagagatatgataaagaaactgcgtcgacaaagtatgcgcacaacagcaatcaaggataagttgggttttggtcaacacagtactcttagaagtcgttacccgactattgaacaaaatattcaaatgaatgggtcggttctcgagacgattgcgagtggcgatatcggcggagatccagcccaggtggccatcccgatctgtttcttaaagtgccgggcagcacgtgttcatttggagatccctacgttcttag

SEQ ID NO: 1282 - DNA, 549 bp, Ctenocephalides felis
ctgtaggtctgtgttcctcgattctaataaaataacagtgtcattttttaattaaaatgatttaatttaaacaatcagttatgttaattgttagttaaatggatagttttaaacagtgagcaagtgttgaagtgttaagtgaatcagtgcatttaagtgtgtatgaatgaaatagtgtttccatttggattaactggatacagattttactgaagacagctggggaaaatatggcgttctgtcagtttgcaaatgatggataattattaaactaaaggacccggcataatgaaacctgaaaatccacaaaactaccacatgaaaatctaaaaattttagtcaatcttaacgaaaccaaccaaagcaacaaaactatgaaaaatccaacaacatttccgcttgaactgtcatctaaaccgaatctttagatttcgtagttcaacatcaaaccacttcaagacatctttctaatatttataattcacttatacgcttagacaagacaactttctatgacggctcgattgtgtncaaatggttgtaaggcat

SEQ ID NO: 1283 - DNA, 383 bp, Ctenocephalides felis; identical to SEQ ID NO: 342

SEQ ID NO: 1284 - DNA, 549 bp, Ctenocephalides felis
gcgcatcggagcggttccctaagaaacatctatccgtcaatctatcaaacttgtaaccgttaaaaataattataagagaataccttaaaataaaaggtagttttcgtttaaaatatccttaattgtgaactatgtgataataagtgttttaagatagtgcctatgttaatatttttgatgacgagaacagaataagagaacaaaacgggatactaaaagacaagagctttgtttgacacgacagttgacggagactagaatgcaattgtgattttgaatatattaaattttaaaataattagaaacaaaaatgtcgaccaaagacatacaagctcagacaaatggggatgctgacatacctcagcggcgaccccaacataggggatgttgtagcaaaatgttatatttttttaaagtttattggagaagttttgtaatagtattagcaccaatattattaaccccggctttcttgtaataatgaaccgaaattccggtgatgatgtagttatgtaatgctgatattggttaccgaagtttacctctcca

SEQ ID NO: 1285 - DNA, 541 bp, Ctenocephalides felis
gttgctgtgggtcttttacttttgggtctggtgatcgctggacttgtcaaggccggatttttcaagaggacgactaaagaagaattagaagcacttaaagaggctgatcagagtgcaccaggaataagtgaagaggaggctttagcgcacagccatgatgttgaaaactcatctgaaaaagaagaagcttaaactgtgttgaatgcaatttcaagttgtaaaatttttgtgctttttgtatatagatatctacaaatatttcgcagaagaagtataagaatgtttgagaatatttgaaatcaagagaaagttgtgtcataatcataaacgtatttagatcataagtagtaaacattcaaatatcacttaagtagtgtaaatatgagactgaaagtgaacgattaagcatttttatatttaaagtcatataatttatttctaagattagatatagaatatctgtgatgaataaattccaaacgatatattataaattattaataaatcaattctatataaaaagaaaaaaaaaaaaaaaaaa

SEQ ID NO: 1286 - DNA, 549 bp, Ctenocephalides felis
ccttattgcaggtgtgatagtgaaaaatattattttataatacgagttttattcttgtcaattttaaatttccggtatgcaatatgtatgcattcatacaacaaataaattacccggtgcacaattatgcagtgctgttatttaaaagataatgaaaattgcataataattagaaaatatcataaacatattcattagtcattttgtttttatgtgaaaaatatgtgcataaagttgctgctgaatagaagtcggatttcctcaataatatagaaagaaatggttcaggctgacccaacgtgcagcctctggctggacaaaaacattgacagcagacgaggatctgatttttcccgcctggacttcgacacgagttcaatgtttgaatcgaatgtccagttgtcaagttcattagatgtcatcgactggcaaaaactaaaattccaaacggctagtatcaacagaggatcgctgaggagcaaatcatttgtataattagaccaaaagatacacattaatggaaattcggaggataagggaaagattctt

SEQ ID NO: 1287 - DNA, 549 bp, Ctenocephalides felis
gggccaaggaaccaagccaaaggccaagacctacaggtgcagctggtgaaacctttccttttcctacaacatccatacagaggtccgggcattctatggagcgaccgcgaggggaaacaattaggagatatccaggtacaactggtgaacgccccgccacgccaatgacaagaacaccacagagatccccgggccgcgcccccattaggattataataactccggtcagtaaaccctcggggccgcgatcgcccccaacacgtggcagaatattaagtgctggccatcttgcgccccctacaccggtgtatcggcgcagcgcctctaagggttcttcgcccagaagaagaccagaaaggcccagtgaagttatgcaacccaaaaggagacgtctagaatgaaacatcccatttaattgctgaagagctttccatttattttgagagtcaaccaagaattgcagcagcagcttcgcagcagagataatgtggctccaaaactctgcctagacaatgacaccttcgaattcatttgcctactgaataatga

SEQ ID NO: 1288 - DNA, 384 bp, Ctenocephalides felis
atttatttatattaatatattttattggggtgataggaaaatttataaaactttttttttattaaaacataaataattgaataattgatccataaattatgattaaaagattaagttacttaagggataacagcgtaattatttttaagagaacatatcgacaaaatagattgcgacctcgatgttggattaagataattttaaaatgcagaagttttaaaatttggtctgttcgaccattaattcttacatgatctgagttcaaaccggtttaagccaggttggtttctatccttaattttttaaaattaattagtacgaaaggaccattaatttataataattattttaatttgaataaaattaaaaaaaaaaaaaaaaaaa

SEQ ID NO: 1289 - DNA, 548 bp, Ctenocephalides felis
gaccactgggcttgttctcgaacaggactggcagtcgaacagcaatgattggtttgtagtgtatcgatttttatatcttaacatatgtgtaaataaagtgatatttaattttttatatgtacatatcaaacaaagaataataaatgatggaaattgtatttttgtttttcaattcatatttttttaaacttctgtaatctgccctcgtatgttttattttacatgtacgattctgccaatgcttggtggtcaccacttgtctgcaatgaataaaaaggaatacctaagaccgtgcgtgtttcgacttgatccagtaaccatcactaatataaacctgccactgcattttaaacaatcgagcggaatcacataattacggtaccatttgcaagcgtttttacatatgaaaggaaactgtttatttaccataggcatgttagacataaggtagtaggattaatcgtgtatccccagagtttactgcaaataaacttttggcaccacctcaatgagaagcaattgacttcacttgcgactagtttggtttc

SEQ ID NO: 1290 - DNA, 549 bp, Ctenocephalides felis
ctggttttgggtctaacagtattaatcgccatcgtcagtggacttgtaacaggtgtggtcctgaaatatgcttgtgctcaagttgaagaagaacataggcacgacgattctccagcatgggaattacctcatgatgaagaaaaggcggaaaatcatcatcaaaatgttgctacaattagctgaatatttgttctaactatattgtatgagactgttcgaaaaatgaagaaagaaagtgaagcacaatttaaataattttaaaaatactaaaatatctattaatgtagttttagtgtaattactgtgctttaaacacaatatttgattttatattgatttataaaaaatatgttttaatataatgtcataagaaacaactaatttgccaaccaatttgtcaattggttgaatagaatttaataaaaattaatgtatttttattcaaaaaaaaaaaaaaaaaaaactcggaaatatataggctttcgatgttgatgccaaaacagaccggtccaatctacgagcccttttaaggagggagtatgggccaag

SEQ ID NO: 1291 - DNA, 549 bp, Ctenocephalides felis
gctttttcgataactcaatttttgcttcaagtaagcttaagaatttttgaaaagcttgtttgagtcccaagtaagcttaagaatttttgaaaagcttgtttgagtcccaagtaagcttaagaatttttgaaaagcttgtttgagtcccaagtaagctttcgaaattttagaaagctaaagttaaaatttttgtttcaatgtttcaatgtttttgaatcattcttatcggatgctcctttctcttaaaaactgcaattttttcacttgttgctccgtatcttcgaaactgctaaacctgcctttggcaaaaagtaatcagcaagccagtacaaatcgaatgtttttagaatcacgctcggaatcgtagacgaaaaattttatccaaacacacacacatacacatacattcgatttttcttcagtatgccataaatttataaagaagaccttgactcactatattaaaaatgncatgtgagatttttgccttccctaaagaaggtgtaaaattaggaatttatcatattcttancagagcgcccttactga

SEQ ID NO: 1292 - DNA, 549 bp, Ctenocephalides felis
atacagcaagcaatcggtgccagtttgtctaaatacccaggacctgaagaaacttttgaggctcttcgaatattttgcagaggagacttcttaaaattgactctaggatcattgacaagtgtgtgcttcaaaacaaatcaaacaaaagctttgaaattcctcaacgacaactttgatcaacctgtgtctgcaaagaaacacataataagactcatcaacgccatcggtaccaaaaatgtgattttgaaaatgctgaaacaactctgggattgtgagaagcatccttctatccgtaatgttttaataacgtctgtcttcaattggtttgcgagtgatcccgatgaggaaatatggaatttgttgaaatctatatttttagatctgacgaccaaggataaagatatattcaccatgcttctgagtttcgccaagtcgacaaggattatttaaaggaacatattgaactttgtggaagacgcaacaatttggagtccaggataaaatcaatttggatgatgagaagtctaaaatctgcacgcgtaacgaaga

SEQ ID NO: 1293 - DNA, 549 bp, Ctenocephalides felis
gtgaagtgatgtaaagaacgtatcatttttttattacttttattgattaacaagtgtttgatttcggtttacattaaactacaatttattgacggtcgtggcggctcgccctagtgaaatttttgagttgaaccccttatatgtaacactgatactgcacttatatttattgatattgtctgtatttttacattttgtgttcattattaaaacttaaaaaatgaatgtcgaagttacgccgaactattcttacgtctttgatttcgaaaatgaatttattcatcaagaaacgagaaattggatgactaaaaattggacatggggcttttattattgtggaatctacatgcttgtaatttttgggggacaacattacatgcaatcacggccaagatttgagctccggggccttctgacagtatggaatgctgnctagcaatgttttcgatcgtggtgcctgccggacagctctgaacttctcacgtgctgcgcactacggattgtccatagcgctgcgaccaagcttcatcgacaagacggtagcggttt

SEQ ID NO: 1294 - DNA, 549 bp, Ctenocephalides felis
gtaaaatatttcaagaaacctgagccaattccaaattattgtgacacaagtgttaagagttcttctctttcatcgagtcgagaaagtggtcagaatggatctaaaacttcagcaggcagcagaagatcatcattaaaaaagaaggaagtaaaaaataaaaaagattccaaacggacgagtttgtcttcttaccaaaccagctctgaaattttgagaactgaaagggaaatattgtctcaaaacttggaagatgttacctctccgctggaaactttgatcgaagagccgctaaataacgatttaaaaggctctaatcaaaatgatgcaccacaacacgtgtttccggattctcttgaccaatctcatatgtcgtctttagaacctttacccgattggaaacctgttatttcagatgaagattgtcgatcactttcaaaaatggtggatgtatattggacgagtttcagaaagggtatggaaggcaaggttgtcagatggacaatggaacatatatcaaattatttagggagaattttgcaatcttcaccc

SEQ ID NO: 1295 - DNA, 547 bp, Ctenocephalides felis
naaatnnatgtggcaaatgaaatgagtgagaatcgttgnttaaagcattaaatcgtntaattagttatttttttgtatattgggcttgcgttttaacgncccgangatctnatttnnttgnacaataaaantgttnattgnttaacattancaanttaaaantatctgantcttgnctttaaaatgacantntgtatnggtgctggtacgtggggccaaagtgtttatggtgcaatgcgcacgttaatccattntattgcggcaacacaatattggtntgcttgttactatgattggaattttgnacacgtncngnagagcgttcatgtnatgggtaatccgttcggtggaaaattcaaatatctgacatttattgatgccgatctgcaagccttatatttcactgtttgtgtattaaatgactttgctggatcaaatgaaactcgnnnangctaaatccttctgcagtctgaaagacncatgatgcagcattcgcnttnctgntgnatgaatgnggantcattttggaccntnngctttgacaggc

SEQ ID NO: 1296 - DNA, 549 bp, Ctenocephalides felis
attntaattaaccataacttattgttatgttaaatctttaaataaatcttatttaattatatttatcaattatttataagaaacaattttaaaacattccttcattattataactgggatgaccggaatgaaaatgttagcacctactttgcatttttcacatgataactagcaatcttgtgaggaattgtattaggcctcagtaacccatgaagcgcccttttgtaacacaataataatgattcatccttttctactggttctagataagcttgcagaggataacacaacttttcttcagggcaatttaaaactcttaataatccagaatgttctgaccaaatttgctttctccaacaaatgtcgtggcaatgtgctaacggaactagtacacaagctgaaaacatttcatccccataactaacagcttgataatgtccagaagttttgtatatagatcagtaaaactgcttagaccttgtatggttggtaaagcaaacggtgagtaggccaatttgaaattcttcgaaatgctttagcaacagaggt

SEQ ID NO: 1297 - DNA, 464 bp, Ctenocephalides felis
tgnaacaccacattagcaaattcacgaatattngagttgtggacaaactattaagaaaataatgattaattatttttatcaagattctttaatttgatactaaaatgttttgctccacaaaatgactaaatatactttaaaaaaacaactgactagaatatattgaaatttacattcggatatatttaaatacttactagaccacaaaaatatttgtcaaagtttgtcaaaaatattttgtatatattttcttgaatatcgacagtgataacgctggatttgtgctgcctggtagattttttcttgaaaaggtgatattactcctatgatttgtatttatatgaaagtgctttatattattttaatgattataaataatagtatgtatgggatattatataattgtgtatatcgatataattgttgcctcaataaaaaatatttttaaaaaaaaaaaaaaaaaa

SEQ ID NO: 1298 - DNA, 547 bp, Ctenocephalides felis
atgtgtttattattctaacgaacatgcacagtgattctaatttatatggtcataaaatgtagaataaataaacaataaattctttgataaatatagtatttagctttagtatccacgtgtcactaataattttacaatgcgcatgagtccgaaactgataaaaggatgcggtataaacaaaattccttcagtcacgcggtaacaattgtcagaataacactttaatctcattttttgatgtgaattactttgtaattaatcgcgtattctacaaatcacgatgaaagttaaggacttgacattcattagagaaagacttacattcccattagttttattatggcttatcgcatttcctgttcgagctatcgaaccaaatgaaattctttttatcatcctgagtcaaccaaatacttatagttcaagtttagctgaaagtctgcgaaaggatattttaagacaagccatcgatctgaataagacgccgcaataatccacctttcacacctggattatccgcagcatcttcatggccgtctccttattg

SEQ ID NO: 1299 - DNA, 549 bp, Ctenocephalides felis
atataaagcagacacctcccgaaaaaccgcccgcctatgaactgtttgcgccccctgcctatgaaacggttgtgaaaggggcagacttaaatggaaagaacaaaggccctgaatgcactgtttttactataagttagtaaaaaacgagtgaagtaaggctacctgtttatggccaaatcaaattaagatagaagaccaagagtcttttgcactttggagttacttgtggtgttcagcatctggtggactgatttggccatttgcagggcgctgagccgagagataaaataaaaaatgtgtgactgcaatgataaatgtttatcaataacttatccagaaagattatttaggatctttattgctgcaaactttttcaaaagcgaaagaaactctggaaaatcattgctaatttatctctgtgatataataaattattattcaataattatgcttgtagttttttcttataaatatgaattagataattaataaatataagtaactgtagtattattaaagtcttntttattagcaaaaaaaaaaaaaaaa

SEQ ID NO: 1300 - DNA, 549 bp, Ctenocephalides felis
gaanaatgaatctctatctagtagaagtattactactgacgacttggaagctgctcgaaaatacatgtctagcgaatcgccaataaggcagggtattgagggacgaatcacgttcatcaatcttggcgatcctaattcatcagttaacctgcactcatcaattggaatgatatcatttatattctttattgtcttcaaacatttttgtaccttgtaataaaaacatgtatatttagattaagcaacaaaatgtaaatctatttttgtcacaaaagacattaaccagtaattaatatgaatatttaaatatttttattagtactccaaattataaatttgtgacttgaaggtttaaaagtaaaacaagaactttgtgtgtgatcaatcactttattaagaaaatatttgtttttttgttgtcatatggtgctcgctatattgtaatcaatatgtatttattgattagtatatttatcacttatttgtgctaattattgatcttatgatacatataatagaaatgaaaatggttcacaaatctcattaatt

SEQ ID NO: 1301 - DNA, 320 bp, Ctenocephalides felis
gtgcatacgcgttacatatcaaatgaatatgaattttaattactatacattattatttgttttaataagcgcgccttacataaatagcgccaaattcacatgtctcacggatggcgtgaaaaaggaaacatcttgtgcagcagattcatgttttcttttatacaataaatataaaggtgtgcgggagtatggttgcataataaaaatgacgcagagccaaagaaaatactgnttccgtcatccagaattatgctttanctnccaccccgaaaaacctgtaattcaatgaaactgatgaaactntgccgcgaatgcctcac

SEQ ID NO: 1302 - DNA, 549 bp, Ctenocephalides felis
actgggaagacaatcaatcaaaattcataaaaaagttataaaaagttagaaaaatggttacaaaagtagcactgttagttcttgctgttgctgtcgcccaagtttcctgcgatggattaacatggaagtaccatccatctctttcagcatttatgctgaaaggtaaagacgaaatgggtaaagattgttcagctcctggagaaataaagtgccaggattgtgagacagcaaacctttgcattgcgattggtgctgatttcttagaaacaacattggaaacatgtccgagtggaatgacttgcaaaccaggtacaggttgcgttagagcctctgaaaatacattaaactgtcctgatcaaactcctcccgtagacaacagttttgtatgcgaatctattggtattttccctgatctggaagactgtaagaaattccatttctgtttccaaatacagaaggtgttaaagcttccacagaagctttacctcattctgaaattaaaatatgtccatagaagcaatcaaaagtcagaccagagttgcaaaacaa

SEQ ID NO: 1303 - DNA, 417 bp, Ctenocephalides felis; identical to SEQ ID NO: 478

SEQ ID NO: 1304 - DNA, 549 bp, Ctenocephalides felis; identical to SEQ ID NO: 216

SEQ ID NO: 1305 - DNA, 549 bp, Ctenocephalides felis
atanaatcagtgttgacaaatggtttgaggaaaatgagaaaaatacctgtcacaaaattttatattgcaaaaaaccaggtgtagaacacatgtaatactagaagaatggttaaaatgcaggtgaccatttcaaaggaatttgaatatgataaaatatgcatagatggaactcatggtacaaatgcttatggatttaccctgcatactcttcttgtaattcatggggcaggttatcaggtagaattttgtttcacaaatcggcaagatgaaactttatttaaattattttttgagaaaatttttgggcaaagtaggaaaaattgccacctcaacttttatgtctgaggatgcacctgcatactacaattcatggtcatctgtcatgacttcgacaaataaccatttactttgttcatggcacatatcaagaagctggaaaagggtacttaatacaaaagtagacaaagaagtagatcacaaaagcagacaaacgttttcacatcttattaagaatcgagtgagatgatttttggctaagtnaatcttatt

SEQ ID NO: 1306 - DNA, 549 bp, Ctenocephalides felis; identical to SEQ ID NO: 372

SEQ ID NO: 1307 - DNA, 549 bp, Ctenocephalides felis
atttatttcaatacgtgtgaaatatattatatggttaacatatttattcatcttgtttttaaaataactaatttgctatgaaactaatagtaaacaaaaaagttttttatgccggcattaaaccagacaaatttttgtgaaattgaattatttatttattttaaacaattaaacttaataaaaataatttcattttttttaaataattggatgaataaaaaactttttcgtttactgttatatctgtcgccatctgaaatactattgctttaggtgtatataaatatctatttacatattttgcaggtatctgattaatactaatttttgaatcactggtttatttaaaaaatatttcacatttttaggttctaacagcacnacactttgctacatttattagtaaatgttattaattaattatgtataatactttgatttcaactaaaattttgacgcaaattgaaatgtgcttaagtttacaagcagtggccggacgttggcacccatcctgacttggggaggaagacattgtgtacanctcatgag

SEQ ID NO: 1308 - DNA, 549 bp, Ctenocephalides felis
aataaatcattttcaaaatggtgtccaaagtgtttgttgctcttgccatcattggctttataggggctgcacaagcctttttcgaacaagatgccgtcttagataagatggtagatgacatctctgctgaatatgagaacagcattgcaagaattagccaagatagcaaaattgatatgattgccgctgaattcgaaaaacaaggatttgcccctgaagtcgatagagatttggagaggttcaacaaagaagttgaaaggaaacttagcaaaaaagtgagtgaagccgcaaaggaatgccttaaaggccaacaccaaaaagctctaggctacgcacaagaagcccgtgctaaggtcaaggcttgcagagatgacaaacgtgatgaattcaaccaagttcgcaaaatggcttgccgctggagagaagccagggagaacgccgaagccctcagagcacaagccaaggagtgcgttgtgaccgcagccgtgtcgatgaagccagagtttgcttgaaaggggttctccaagctgcccgaagagcaaagacttg

SEQ ID NO: 1309 - DNA, 445 bp, Ctenocephalides felis
attgcatggaagctagactgcaagtatcatcggaaatgtatggtgaagtgttggagaaattcaatataaaaatagagatttttcaaaaaagattagattactatcgtaaaagagcattattttctatgcaattagttcatgatctaacaatatcagatgacaagaacttagaaaatttgtttcttcaatctcgcttattatatttgcaaggcaataacaaatctcatgaagaacttattaagtttattagatctccaagcaaagatgcatattttgctaatggaactagtatattaaaaggatccaacaatgaaaatcttgccatattagctcttaataacattggagttattgaattttctcttggtcactttcatctagcaactcattcacttcaacagtcattaagtagagatattcaactggtaaaaaaaaaaaaaaaaaa

SEQ ID NO: 1310 - DNA, 549 bp, Ctenocephalides felis
atgtatcaagttatattttcttttgtataataattacattcgtttagttaagcaacttgtttctagtgataattgtagaaaagtgtagaaaaatgacacctgcattatatcctgggatgaagaaacgttattttatgtcgatttctttagatgacaaaggaggtaaccaaatagcatatcttacaaaatctgaggacaataataaggatcgtttagcaagtcggttgagaagcggatcgagaatgattgtttgaatataagtcgtacaaaattggaatgaaacgatgaacaatatacagatctttagacaggctcaaataatgtatgtttaggagcaacttgaagataatggagatttatcttcttaatataaaacctctaaaattgggaacagtatgtcatatatgcatgaacttgattgatgtattgatgtataatgaactgaagatagaatgaattcaatcaggttaaaaaaaatgttggcaaaagcgattcgatttagatttgctcctgatataaaacttccagaagtcatcatatatgaatatc

SEQ ID NO: 1311 - DNA, 549 bp, Ctenocephalides felis; identical to SEQ ID NO: 275

SEQ ID NO: 1312 - DNA, 423 bp, Ctenocephalides felis
aattnatttaaagtcgaaattccaatttgttgtactttataagagtaaagcaatttcactcacatctataatgtgtatacatgtattacatttttattttattaccttggaatattgacattttgaatgaaacattagtaattttgttgtttaaatgctcacctattacagtaataacttgtatgtatgttctaaacctttttaaaatttagaaatgtaacgagttatgtggatatttgtgatctatgctgaatgatactatttagtggacaaaattgcagttctgcattaaccttttggtgagaatcttgcaatccaatattgtgtagttttagtttataatgtacatataagcaaccttaatgtaagcattaatttaatcaataaaatcttttctatatcaaaaaaaaaaaaaaaaaaaaa

SEQ ID NO: 1313 - DNA, 549 bp, Ctenocephalides felis
taatattttattgtaacagaggcaaaatctagaaattatgggatgatttgtgataagtgtgaccacattaatggaaccagagttttaataaacgcattttgaaccacaagtacaatgggatgaacttaataacttctggaattataatcatttataaaggtggactcatttatttgaagctctatgtaaaatcctgctctgattagtataactactgcatttcagaatggaaaatggtgctaagaagcttgatataaacaagtataagctggatgtgtcagatttagcaaagcaaaactaccgacaaataattgaaaataaatatagcagtagtattccaaataaccaagaggtgcaaaactcatcaaatgcgggttccttgatgtctttgacaacaatatctatgtcatcttcagacaatagttatcaattatctcaaaattgcgaaaaagagctagtgcaagaaaattggatatatactattttccagntggtntcctttatgatgctggatnggacataggtgcagtgcatactcacctcgccaca

SEQ ID NO: 1314 - DNA, 549 bp, Ctenocephalides felis
gtcacaatgtgatatttatttttatattttaaaataaggaacatgctggagcaagaacatgtatcattaaatttacccgatattaaggagtccgttactcatagaaaaagcatatggcgttggtggaatcaactgtccagatttcaacgaagtctattttatatgatagtattagttctattttttacactcttatatttattaccaagtcaacataatggagatggaaaaactatagagcatatacaaataacaccaattgaagcaaataacttaccatttttacaaaatgatcaagtggtatcacctattaatttaaatcaaaattcagaaactaatggcttagatttagaaaaatcaattaaagaagtgaggaaaaatgtgattgatgaaccaaaacaccacactgaggcaatctatttaaaaagtagtcttgggactagtcatggcaaagtttttgtggccaaaaacagaaagacagaaagcagtgtgaagccttcaagctgcttggaagggcttaaaacattgctggggcacgccattaaccat

SEQ ID NO: 1315 - DNA, 549 bp, Ctenocephalides felis
attaaattgaaaacttcatctcctaaatgatggtcaatgttacataaaattgtataagatagtttgtgttaaattttacgacgctttgataatttattaataaacattaattgatatcagagtagagtcaaatcgatatataatattattttacctacttctctggaatacaaatttattaataaatatcgatttcagttacaagctgatcagtagtatattttctgtggtcaaggattgtcatcatgtcaactaaaataatattattatccgcattgctgttgctaatatcttccactgccgtccaggcccaagtatgcagttgtgtatgcatcacaatatgctgcacccccgaacagctttcaaccctcgcctgtccccaagcgcagcagcagcagacggcctgactgtccaaactcaccctcctaaaaataatgctgatgcttacctcgaatacatacaggcacaaaatattttaaatcagtacttacatcaacagcagtgcgacaatccaaaaagtnaggaacaaaaattcttggcacagcagca

SEQ ID NO: 1316 - DNA, 549 bp, Ctenocephalides felis
gtttgcattttcattgtttttgacgcgaaaaataaaactacaatgctgtgacatatatcgttcaagtgtcaaatagcacataaaaccgtatttaaatgaaaaacctctgttaacaatagttggcttgtggttgcctatgtcgtttacctattccccttgtgcaaaccccgggttgtgggaatgtgtaagaaaattagtaaaatgctcggaacgataaaaattgtgcaagtgaaaaatatgttgattaatgtttaattattactgtgaggtgaaattgataattctgtatgaatttaaaattaacggatttcaatatggaagtgactgatagtgatacgaattccagcaattataaggagacgaataaaagtgaaccatccaacacgtctcctgaagacgatgcaactggctgcgaagatgaggacgaggatgagctctaccttcaacttcatcttcatgtaaatctgccaactaaagcctcacttgattcagcatgctcaagtatccagcagtcctcaacgttgaaataggacttccgtcccgaatgct

SEQ ID NO: 1317 - DNA, 549 bp, Ctenocephalides felis
gtcatattattattgaaatagaaaaactaattgttactaattaactaactgattaattcattgattgttggaataactatctgaaagaacaacgctatggctgacgaagcactaaaattcggccaagatggacaacctttgccaagtggtgaagaattattaaaaatgttagaaggaatggacatgtccgaggaagacaaacagagcctgagggattctttgcttcaacaggcaaatagggctgcttctcaggaccccacgggggctactggggtcacattccaacaagtcttgttcatgttggccatggtggcgattatagtatcagttttcgcattttttgcaaataaattatacaaatctctgacgtacaaagacagaatgcgtgaagaaaaaaggaaagccaaggaggagagaaagaacaaggaaaagaagaaagtcaagtagtcattttgaaaacgacaagacttttaaatccataattattatacttacccatagttcagtcagtcagatcaaaacagtntgatattaaaataattttccgta

SEQ ID NO: 1318 - DNA, 549 bp, Ctenocephalides felis; identical to SEQ ID NO: 438

SEQ ID NO: 1319 - DNA, 549 bp, Ctenocephalides felis
gaaccaccttcaagaactccatatgagtcacagtacgctcgagcatctgaagaagaagatagatcgcaattagtgtttatcatagttacctctttattcttctttatcataatatgttgtatcattgaagtattgcgaacaaattatcaacataaaaagcgaatagaaagagaaactgacgaaagtatcataattgcgaaagaacatgcaactaagctgcacgaatcaccagctgttggcatgaaatttggtggatataaagcggtaccaactgttgaagatgagaagaaaccagttaccaacggaactttaccaaagattgaagaaaagtgtgacagcgttgcagaccttaatggatccataaataaatctttagatcatctaaagccccagaagtagcagttgctgatatcaacacctgtattccagaaaagaataaagacttttatgtggatcagagaaagcagctcttagatcatgaactgcagtgggactcatggaagacaaggatccagcagacgtgatgcagagcggncatacgaagaaacg

SEQ ID NO: 1320 - DNA, 549 bp, Ctenocephalides felis
atgatctataaaccctcaaattcttaagtaaaactgtaatagtattttaacttataattattagagaatattttatatgaaaaaacatggaatttattatggcaataaagcgtgatgcaatagtgaaaaaaacatctaagtgaaatcagaaaacaacaacaggaataacattttgaatcagtaaaaataacggatgacacttcaagggtgcccagatgaaagggtgacaaccccgtgtccgccgtctccgcccccgattccgctgcagacttatctttgggaggacgttagaagggaacgaaaaaaagggggctacccttggacgcacttcgttaagaggcctttcgatcctgatgctccacaggaaattttggagtacgaccggtccccaggcagtaaacgtaaatacggaagcctagatgttcaggaactagaagagtctccgagtgtcactagaagaagaagagcggatccgtggagagtctttgggaaacgaaccagacttacggtgatccaaacacaggagtaaatcagtantatagaagacaa

SEQ ID NO: 1321 - DNA, 384 bp, Ctenocephalides felis
tactaaaaataattttatcattttcaaaattattgtgcgcatgtatttaagggtaaaatgaaatttttgagttcgattgcgtcacatgtatataagtattattgatgcgccccctagaggggttcagtgcaggtgaacgatgttatttatttaatataagttgcaatgaatgacgttaaaggacttgtggaaagaaactactacttataattagtgaatattatttattaggacgaagtagtttttattgtctccctaatttatctttgcgagtttagttaattcaaaatatatgattttagaattatttgttacttaaaaaaacatgaaagaaatctgtatttgaataaaaagatacacaaacatcaaaaaaaaaaaaaaaaa

SEQ ID NO: 1322 - DNA, 549 bp, Ctenocephalides felis; identical to SEQ ID NO: 277

SEQ ID NO: 1323 - DNA, 29 bp, Ctenocephalides felis
tgtcanggcttatcggatacccgtcgacc

SEQ ID NO: 1324 - DNA, 550 bp, Ctenocephalides felis
ttttaattttcaattcaatactttgcaggatagattttgcgataatgttttattatatagctgtaatgggaaatagcaatcgtagtcacttcatcctatcatcatgtaccatggaatatgagaatattttatgtacttctgcaaacagtttcctgggtgctcctcagcttatattaagtagtaaaatgcagtagatgaggtattgtgaccaaaatttaaaaaaaatatattgcctatttaggcaatatgatatggtaccggcaaagtgtgtttagtacatttcaggtatttttatataaaatttttaaacgtgtacctcaaagagctgcgctatctataatgttccaatgatgtgccgtattgcatacaatgctggtgtttccaaatctttgagaacaattgcattaaatagtgatgtttgaatggatacttttgcggccttatgaacaaatgtgggaattgcaagcaataatacttctagagtagaaattatgctctatttttgtgngcacatcttagactattgagatctagtagattgctgaatgag

SEQ ID NO: 1325 - DNA, 491 bp, Ctenocephalides felis
atcttaatgnattaagtgnaaattaatataagggaatttaatgaattacattttgaaaatgagagcaaaactactttaggatacattttttgactaaatcatgtaataaatttaccatggcccattggaaaatttttctgatactatcgtggcgattaacgtgttaataattttatagtccctagttcgggttaaaataaaaaaacgtgtctcatatttactattcacctatattnaccacttcatttacttcttgattcttcttctcttccatatccgatcttcttgattcttcttctcttccatatccgatcttcctgattctttttctcttccatacccgatcttcttcattcttcttctcttccatatccgatcttctttattcttattctctttcatatccgattttcttcattcttctttncttctaaatctgatctccaattctgctcttgcttttcttttcatttattcttcgggcatttgtg

SEQ ID NO: 1326 - DNA, 550 bp, Ctenocephalides felis
ccacgggatagcagtattattgatgcattgttgagcagtgtacgcgagtgcaagtgaagtattagttgaacaatgtgaaatcatttctagaaattttatgtgatattaataatattgttgtcgtaatggattcagaataatgtaataaatgatctttatttgatgagattattaaaaatgaatattacaacattcacgcaatcaagtaatttagaatcaatccaatcagccaattaacaaaatcgacgaatatttttcaagttttattaatcaaaaccttaaaaagttgataacaagacaaatgatacctacgagcaatcaacaagtatgcctagaagagaccttccggtgatcattgatgactatgaatcctttgaaatcatcagttattcttgatgttttggatgctctatttgctctaacactggttgcgcccgcgtagtcgggtattggagaggnacgtggaatctaatgggacatttgtttatacagataatgaaatatatagcagttcgtncttggcataggcttattggatgttatattttgt

SEQ ID NO: 1327 - DNA, 550 bp, Ctenocephalides felis; identical to SEQ ID NO: 440

SEQ ID NO: 1328 - DNA, 550 bp, Ctenocephalides felis
ggcaaaagctcttgaaaagttcttctgcgacaagtgctagtgttagaaagggcaaagttggcaggccgagaaggagtagagattaactagtgaaaaaatgatattaagagaacattaaataatatcagacagtgattttttccataaaacaatcgactaatgatttgttattctgaattacttttcagaactgtacattttgtttaaagtttggtgaagtggtgaggacttgataaaattttatttaacaatgttttttattcataggttagtttaaatccatatatgtgtaattaaaatattatttaacataagatttttacattatacaatattatataggatactagcattatttcagtaaatgaaggcatactgcttttgtgattttttaattttatggtcatcatttacattttatatcaagttacaatcgtatgtaaatatttaatttaatatataagattattatcattagtattagaatttgtaattgagtagacaatcagcaaagctgtgtgattcgataaacattttgaatgnaagtaat

SEQ ID NO: 1329 - DNA, 550 bp, Ctenocephalides felis
ggaaactcttaaattctctgatttaaaatatgaagaaaaagatcttcatataccatctcttcaggaggtcaaagaagttctatctggaaagttacctaacaatttcactcatgtctctgttgatatagttgagtgccctgatttaaccgcaaaaaccattttgtctcgctgcaccaggtttgagtggaaatcctaatttactcgaactaggtggggctccttatctcttaccacttgttcaaagagaaaaaatatatgatataaaaaacattgctaagtctttggacttgagtccggttttagctataggagctggtgcaggaccatggccatatgctggtgtatgttgtgagggtattttcaatatgcacctagcatctgacggtaccttgaacaacaaaacacacatagctactgttaacatggaaaatagtgcatgcgtacttggaacggtccaaatgatgaacacgttgtgcattattaggaaatctcttctgctgaagacatgccggatctgtttgcgtgtcattgngcactagcatggnctaaa

SEQ ID NO: 1330 - DNA, 550 bp, Ctenocephalides felis
gcgcttcagaattatcgtaattgtcgaataaaatatatactttataatacattcacatattgnatattaatagttttaattttaaatttattactaaatagttttaatttttaataagtggtgatacaagatttagataagagcccgatcgtcccggccggtgataacagcgcaacgcccagcagagacttagcatcgagcgccctcgtcggttctcaacccctgccaaatcgaattcattccgaacgcangagacagccactctcaaccctattcggcataggatggtcagactgccctgggcccangcgtttgnttaacaggggccgntaaagacgaccaaccncagncaacgaatgntgaaataagccatccccactgnttcagttaaacgtgaatggaagncatnggaacctnacccgatcccaccttaagccaaatcttcaccaatcttcttngaacatcaattcctcctngcgaagcngnngtcccagtagtgncgacgttatatgtaacaaacncggtcttaaggaagangccgntctttcta

SEQ ID NO: 1331 - DNA, 550 bp, Ctenocephalides felis
atgaagcgnagcgntatcactaataattgntatatcatcatctaagngataattaaaactaataaaattaagattttttcacttttaatgcnaccnncaacgncatagtttcaatggtggtgactgnatctggctttgntacnattgagtgcnaataattgatgacacatcgttttgataaataagaagatcaaagtatgncatacaatattttctctagtatccgggttggaaacaatttaatttatcaaaattataatcaactttttgaataaactatgatgacatgatgataagaaactaaaatgatattacataattgcatcaaatcatttttcaacccaatattgnttttatcctgaaattacttgatattgacatcatgctcaaattttatttcagcattttcatttgcatcatgnaatcgtacttttattacgtattcaaatttacccgtcatccgtagaccatagtctacgatagtgatgncagaagctgcttacactgncnatagtttctgaaaaagcgataaatctntaaatncgattaa

SEQ ID NO: 1332 - DNA, 550 bp, Ctenocephalides felis
cgcacgtataattttcataacataaccttaaaacaaagaacattttaataggacttaaaaaaggataaaggatactgaaaattagtgtttaataggtcgatagagactgngcggttcacaagtttttccaggacattaggtaaaggaatagttctcggtggattttggattataacaaagttaatttttatttttcgacatgtgtatcggttaattatcctttatcctgattgngattgnggttttgttgtagttatattcttaaaggcagtgtactgtgactgtgaccgcctgtgcctttgcatgtgtgtgtgtgttgtaagttgtaagagtgctttaattggtggaaccagttttgatcaagagtcaaaaggaatgactttgaaggtgcgtcattgaaaacaaaatgcctggtgcatttctacatatccctaatccttattagaacctaattaaaantaaattaaatctcagcatctagatcaaatatgagnacngggatttcttgtatacaggttcctcattattacatacattcctccatactcat

SEQ ID NO: 1333 - DNA, 550 bp, Ctenocephalides felis
gtgttatcaaaaattttcaacatatgattagaaggngaaaagttggtgtgaatgatgttaaaatattcttatgataaatgnttttgaaaagaagcaatatggatttatcagatatagcgcggcgtctgaagaggaactttgatagctattcctcatatcgtcgtttcctcattgttttaatactgtttattctaatgcttttatatatggcaccttcagccttcagatggttgctatcgagttctaagcctctagaaaattatgaatatcgttgtatatcagacagattagcagcatacagtttcaaaagtgccgaatatgatgtgaatattagacataaacctctgcaaataaatgaaaaagattttataccatatgctggtaacggtttctttggtttggagatatctgacataggtcatataaatataaaattgggtagatcactaaatcttcctatattttatcacccattggttatgcatctgctgcaatggaaatagcttcgaagctncgttgttgaatataaaaaaggatcattcacaaatcc

SEQ ID NO: 1334 - DNA, 550 bp, Ctenocephalides felis
gtataatgcaataaataaatctaaacatataaatcactaaattatcgcgtgtcggtcctcaattgcattagtgaaaacaaattgtgaccatacagctataaaaaaagagcgcgcgaatcattaattaaagtttggctaaattttattttgttaaataaaagtatgctctttattttttatgtgtagttatctgtattatacaatgaggggagaatattaacatttctagtaaaaaaaagttaccggcataaatgtttgaaaatgagtgagcagatgagacaattatccaatagtaaaaatctttccctttctgtcaattataaatctcgtgacaaacccataatagaggaagctattgaaacaaatcaagtaaaatgtcagttgtcgaagagtttaatatggggatgcttgaatgcagccattctcgctataattggtttgatttaattgacgatgctttatccgtggcagtgaccacagatgaatgagtttagcagtttatactattgactatttcccctgtgctgtatattatattcaactggtagac

SEQ ID NO: 1335 - DNA, 466 bp, Ctenocephalides felis
gtaacttggaaaaagagctgtctcatgcaaagaaagataaagaggctatggtttcacaagtggaacatttgcataacgaatatgataatatggctgataaattagtgaagtatgaaagagaacatgtttttaaggccagtggagaaccagataaaaaagatgactagattaataatcccattcattttaattttagattttttggaattttttgattcatttattctcacatatgttttaattttgtttaattattattacaaagtacatattcaaacatatttaactgttaaaccatactaatattgcttgtttcctaaattatttacattaaatttaatatatactctatgctaattgtttgttaagaatttgtatttgtgcttaagcattgaatatttatgtagtttataaaactatttatataataaaatttaatccaaaaaaaaaaaaaaaaaaaaaaaaa

SEQ ID NO: 1336 - DNA, 550 bp, Ctenocephalides felis
attattatgggggattacagcactcacaccaggctcacacatttacaaaaagatttgcgtctagctttgggtatggccgaggacctaaccttacccatgcctgtcacagcgactgctaatgaagtgttgaaacatgcaaaacgcttggggtttggggaagatgatgtatcagccttgtatttcagagcacgtttttaaatataaatttatatatggttttataatatataaaattttagactaatttatatatttccacaacagaagcatataatttagaaatttatttgtttataattattgactaagctaaaattttgtacttttggaaaattatttctattaggagaatgtagttaagttcacgtgttggataatttgtgttttaaatgttttacatgtaggtgcaatgacatgtattgaagaatagtaatttaaatttctgtcataattttacaataagtaaatgttagttattgatagatgctatgttgcatactatatggagtgnactcattttatttagttacaaaaatttaccgtatgaatt

SEQ ID NO: 1337 - DNA, 550 bp, Ctenocephalides felis
cgctaaggaccccaggaccggccctgcatgtgtgtatatatatagatatatatatatatatatatatatatatatataatagggtggatgttttcgaattttcttgctcacaggagctcaggtgcttccggattgataaaggacaattctctgaaagttttagctctcttaatgggaccggccgtggtcccgtggtaagaacgtgggctagcaaatcctagtcccgggttcgaatccaacctcggtcggttcggtatcaaaacagcttgataccaaattttcacttgaaatcatagatttcaaatatgatttcaagtgaaaatggcctttcgtgggcaaagctgtagtggcaacacgccacttggaagtaaagaggtactaagatggtatcgctttgaaatcaaaaaggaagtcgaatttgtatctctatacaacagaaaaatgtaaaggctctgacatcgtgcaccatgattgagtgcatttcaactcacccacggcctgccttggagaatattcgtaaagaaaatgtataacagtaaaatatgtaaga

SEQ ID NO: 1338 - DNA, 549 bp, Ctenocephalides felis
catcaagcaagttgaactcaataaataggaaataaattctttctttgtttttgattaaatagtgcttacgaggatataaggataatttcaagcagatattttgtgtgaaagttgtgcttttcaaattcaagaacattttagtaataaattaaactaataaaaaagttgctaatatctacttcggttttactgcaatttcttggatgctacaaaatgaattctaaaatattgtgtttcattatattttccaccttttttctggctaaaagtcaacaaataaattactacggcaactcaagactaataaatcctggcccatacaattaccagtatcctcctttaccaccaaggttgccgccaattaattgtgaaccagtatatgccacagttgatttctcatacttaagattcatgctggataaacttggttcaaagtagttcctaaggatatcgtgaatcctcaaaacttcggncaattgtgcaagcttccanaggcggtttgattcaggaagtgctaatgtagtgaagacgacagataggtttctggga

SEQ ID NO: 1339 - DNA, 413 bp, Ctenocephalides felis
caatgattgactgctatctgatactagtgaactaaaatatgttcaagtgcttattctataaactatcaatttattcaaagaaaaatcactttgaacataaattgcaacttattgtgcgaatcattggtgatatattgttttccaggcattaataactatttgattaaataaataattagaaatgttatgaattgtaatttgctctttactattattatttgtaaatttgtgatgcatttaaaaatttaaaaatattcatttgttgaataatatttgaaatgttttatgttggaccattgcaaagtgagcaaactcaaaaatgtattaattttttttttttgtatatgtactgccaatagaaacaattttttatttaaataaaggcaccttgaattaaaaaaaaaaaaaaaaaa

SEQ ID NO: 1340 - DNA, 549 bp, Ctenocephalides felis
attattttaagatgatatgatgctataatggtggaatccaaaattaatatttggaatgatattttgagagttttcattaattgtgtgatgtagaggtgaaaagtataaaaaaggcatgtattaatcaatgaagcatatttaattttaacaattcattttgccaaatatgacttttaattaaaatttatatgattaatattattttaaaaatcaatacaatttcaactgcttattcagatttacatgcaatatgtttcatttaattttatttaatatattaatagtccagttgaatcaatgggaaggcaaatactacatcatgtaattgttgaatactctcctatgtacttttagaatgatatggattgaacgaatgtatgaatgagagttaaaacaatcatattataaaaccaatttaaatcaaaacagtcatgaacctcatattatgcgaaaaactgccaaaaggtttttttaagttgttgagactggccttgtgacatttcaaaatgatatttgagtataattttatattatgagtcttccaaaatt

SEQ ID NO: 1341 - DNA, 549 bp, Ctenocephalides felis
cgaaaccaactgaagacgtcacaaactggtcaataaaagcttattaatttctcgataaatgctattttatcaagcgtttccttgttaaatacaaaattatagtgattatggatcgatttcctaaatctcttgaaaatgcaattatcgaagcgaaaaggcgctttgaagaacaaagtgctttgacgtcagagttaggaccagcaatatttgacacccgtgatgctgctccatttgctctaccaagagcatatgtaacaggtccatgtttaagctctgacgaaagttcaaacaatagtagaacttctgaatcagcagttgttgctgtcagtcaccatacaccgaatgcattaacatcatttttaaatgatcgttattatatgggtcacaaaaaatcaaggaaatgttatagtattcaatcattttcaattcgatgactttgaaaatcgcgatggacacatgaagatgtagaagaattgaaaatcttttgggataaggtaggatcaagngaagttatgatgacttacaggtcgcaatactgnagtgtcatng

SEQ ID NO: 1342 - DNA, 549 bp, Ctenocephalides felis
aattaatggtcctttcgtactaattaattttaaaaaattaaggatagaaaccaacctggcttaaaccggtttgaactcagatcatgtaagaattaatggtcgaacagaccaaattttaaaacttctgcattttaaaattatcttaatccaacatcgaggtcgcaatctattttgtcgatatgttctcttaaaaataattacgctgttatcccttaagtaacttaatcttttaatcataatttatggatcaattattcaattatttatgttttaataaaaaaaaagttttataaattttcctatcaccccaataaaatatattaatataaataaatttaataatattcttaaaattaatctatatttatatataaaactttaaagggtcttctcgcctttaataatatttacgctttttaacataaaaattaaattctatacaattttattaagacagtaatatttcattcaatcattcattccagctttcaattaaaaaactatgnttatgctcctttgacagcaaatactgcggcttttaatctcatg

SEQ ID NO: 1343 - DNA, 549 bp, Ctenocephalides felis
aataaacttaataacagacgtttattcaaagattaaaatgcgtataactaatttacaattaatgatgtgtttgatcaattaaattaaaattcttgggcctttgcagattattagcctatgaaaaataacttttgatagtgacgtatactgcacaaataactctaaatttcttgtaaatattcttgacaagatggaaatggaaacagatgctaaaaaggacaataaaaacatggctcatgttatgctaaatgaagtcactgatatgctagaagatgatttgcagccgatcgaacaatatgattacattgccttagatgaattgcaaccaatggaacaaggtcttgaacaatatcaagaaacaatggaaagtgaagaaaatcaaagtgaagaacagttgcaacagcaggaacctgaagttgaagaagtttagtgccagaaatagaggaaaaaccaattttgtcaaactgtcctctgtagaacaatagctccaacctgagtctcaaattaattggggggctcaggcagccaattgtttatcaaggcctattc

SEQ ID NO: 1344 - DNA, 549 bp, Ctenocephalides felis
atcacatagatcaataggaatttatccatatcttagagttttgaaggtatctgattatgctgacattgttctaagagaagctcgtagaattgccgaaggctctgaaacttacagtccaacagtaaatcaattatatagagatttaggcataagagtacaatccaggtatcatattgaagtcaaacaaacaaatggtgttctggaaaaagtaaatgaaatatatgatcaatattgtttacaaataagtgaaacttataaaaaactgcaagatattaattatttatctgaagagctggattcattagataagttaagtgattttaacacaaggcagaaatggcaactgctggttcatcaagaaaatcatggagcaagcacagatttagaagaagtaaattgccttattcagtgtgctagctgtggaaaattttgtacaatatattgatgcgtgatttaaaaatagatgtaaattctatgaagatgatagtaaacaaaagaantgcttcngattttacacttattagaaatcaaggaaattgtaaagaagag

SEQ ID NO: 1345 - DNA, 549 bp, Ctenocephalides felis; identical to SEQ ID NO: 488

SEQ ID NO: 1346 - DNA, 549 bp, Ctenocephalides felis
gtggattagtatatcaacctctatcagaagaaatcagatgtccaccaacgccaatagtgacacgctatccaagctatttgagcagtccgttccatcatgaaaaaattacccccgaacaagtgtagctttaaaatatttaattctgtcgcaaaatttgcttggttagtctccatcgtaaattgatttgcaaataacaatataggaattttaacagcagcgctgtttgtacaaactgtagtcaaagagaacaaacctttaggatcagaattaatttatgttactttggcttatacattcctcgatcaatttacttaagtaaaatagtacactgtggatacttcaatgagatattgtcatatgtaacggcatgggtaataaataatttagttgtttatactgtctacttaaaataaaattggttaaatatgactttataattaaacatatttaaccacaggaaattagtataattagtaatgattttaacattacattgcttgaagaagttatgccagctcatgataatatcttattgtagtttatgataag

SEQ ID NO: 1347 - DNA, 549 bp, Ctenocephalides felis; identical to SEQ ID NO: 373

SEQ ID NO: 1348 - DNA, 377 bp, Ctenocephalides felis
attttatgtgccagtgctcctaataaatagttaatattagttcatattttagaatcaatttaagtttacttgtaaaatagatgcagtatataatataaataggggtgtgcattttaaagtttgcattgtaaaaccaaatacttctcatattctgatgcaaatacttcaataatttgttattgttgcaataagcaccccaaactgttgtaaatgaagttgcatgatgtgttaaaaatatcaacgaatattcaacaacataagtcaagaatgaaatgtaatttctgtatatataggtctgcatatgatttgtttgttacgatgtgaaatttcaataaattgttgacttcgttgaaaaaaaaaanaaaatnaaaaaantg

SEQ ID NO: 1349 - DNA, 349 bp, Ctenocephalides felis
cattcggttttcacaaataatacaaaaaccagattattaaaatgattggagtccgcgccatcacaaagtcgtccccagtggtcagaactcttttgcaacagaccaggaacttcaatgatgcttatccagtagtatcagggcccccaaggactaagatttctactgctgagaaaattgtccatggagccgtcatcacagtcggttgcttggccatccccgcttgggtgctcctccatttgcaagaatacaaaggagaacaataaacaatgaaaattcttagtaaatgtgtgataagtgtaaatttaactaaatacaaaggaataaagtaaaaaaaaaaaaaaaaaaaaaa

SEQ ID NO: 1350 - DNA, 549 bp, Ctenocephalides felis
cttcaaacctttaatgttttgaaacacaaactgttcataatcaattgtagttttgtgataaaactcaatatgatcgtataaacctgtgtacctagaaaaaacagaggagcagggagggagtggacattttattctggatttccttgatggtgtacctataaaattttccttagtactgattggggaactgggaatgggaggcgtgtgaatttgaactttagtagaggaagtacaaggatgtggcgataaacttacgtgggaatgtttgtgaagacgatctgatatggaaggagcagaggtaaaagatgagcaagcagaaagtggatatcttagtttctcttttgttgatggtgtacctgtaaaattttccttagtactgattggggaactgggaatgggaggcgtgtgaatttgaactttagtagaggaagtcaaggatgtggcgataaacttacgtgggaatgttgtgaagacgatctgtatggaaggagcagagtaaaagatagcagcagaagtggatatctagttctctttgtgtgngtcctgtaa

SEQ ID NO: 1351 - DNA, 549 bp, Ctenocephalides felis
atatgaagaaaaatcctaataatccagtattaggatgcaaaacaagaacacatttatcgaagactgccaaagtatttggtgatgaacagtcagattctttaaattttaaatcattgctttctagctgtcctgaatttgcatctaaacccaaagctgcaaacaagcagtactcacaaaaagtatttaaacaagttagatgcaaatctaaaaccttagaaaatcaattagaagttcatcgtagtttaatgttaaaatcaaccgaagtgcatagttcttgctctcagcaagccagaatgaatgaaccatgtgatataacaattgatgaattagcatcatattttgagacttttgttcacatacccaaaaagatgtcttcgatggcagaaatgatgtatatttaatgatatttttttcatatttgtaaattgttacttataagttctctatatttatgtaaatgaattagtgtaatattgataaagtccattagttcatgttttgatacatataaatcaaatagatatacatcatctaagcttaataatagag

SEQ ID NO: 1352 - DNA, 363 bp, Ctenocephalides felis
gcngttgtatcagtacctcatgatgaagtttgcgatttgatggtcggatttgttgaacttttaccaggatacgaggacaaggtcactgctgaagaactggaggaatataccaatgaacacgttcacgaccacgaaaaactccgaggaggcctttacatagtgcaggagctgcccgtactaacaaatggcaaaaaagataaaccaacagtccgaaaaatggcaaaagaaatgtctcaacagatctatgaaaaatacgacaactcgactagaaaataaaagacaaaacacctttgttaaaatagtttgtaatgtagatttatgataaataaaattgataaaaattaaaaaaaaaaaaaaaaaaaa

SEQ ID NO: 1353 - DNA, 549 bp, Ctenocephalides felis
aaaatggctgactccgggggtgaaaaaggaattatagctgataataaagctggtgccgcccctaccggtgatgccttaagacacagtcgaccttcatccgttaataaaggccgtaggcgagtcaggcccatgtcgatggatgctacgccgatcaacgcgcacacgatgcactggttcgcctatctcggcccggaaccagtcgccgagcagcaggcccaattgtcggccgaacaacagggccagcctgacgctgcggcctctgccgatggccaattgtcggatggagagaacgaagatgttagacgttcaacgaacttcgatgccgaaaacaacgacccaggtggtgcttcggcggccgggtctcgcgaccgtcccgcgacggacgagcgactgcggcacgttcgcgacaggcagcaggaagaacgccagcgtcggctcgaggagctgaggcccaacgttggccggcagaggttagggaacagaagaggaagagaggaggaaacggatcgaggagatcngctgaggatatgacagcgctctagtcgaaga

SEQ ID NO: 1354 - DNA, 384 bp, Ctenocephalides felis
attttgataacgattacagatatctacactttgtcggaaggttcgcattcaatagttttaaaaattaaacgatatgcttaattagttcagaacctaaaaaatatcataaacaactttaatataaattaatgtaatcacatcattatgctttatagtaaatattttaaatgttataaattatatattttgaaaacatagttattctatgcaaattacgcaaatatgaacaaatttttatcaacataatattatttatgatataatagtaatgtccgaatttaaaatatacgttctcgtatgaaaatattatacaaatcaaacaatgcctattcgaagcgaaatatctaattaagaaatttatttaaattataaaactgccaaaaa

SEQ ID NO: 1355 - DNA, 288 bp, Ctenocephalides felis
gttaagcatgacccagaggaattgaggaatttggctggaaagccagatataaaggttactaatgcataataagaacttaaattagtaatgcagatatcaaattcattatattgttataggatacatttgaagaactgaagaagagactacattcttggcagcaacaaacaaatgatccctggcgttgtgctccacattctgtgcttatggacactcctggtataactgcagaatgtttgccactatataattgaaattggaacaaagcttaaaaaaaaaaaaaaaaaa

SEQ ID NO: 1356 - DNA, 549 bp, Ctenocephalides felis
acaagtctgagcaggtgcgtcatttatgttaggtaatataaaatttattatgatatgttaattttaaattttataaatcctattcttttttaaatttatcaatgtataataatacatttttgtaattgctactgaaaatgattaatttccacttcaatttcaatttttacgtgattcggtagaggaatagttacagtataaatataatcaatggatttcaagatatgaatttagaaaaaaaatgtttaaaccagcccctagctctcctaccataaatttatttctaatatataaagatgtatcagattaacaactcagtctttccataattcttccaagatattataacagcatgttgccatgtctgatttttttttcattaaaatatttaaaaaattagttatctacgcgtgctccatgcgtcttacacgtccttcttgnagaaacagattatcattatatatatttatatcataataataatcgaatttatagatttatcgtttttcagaaacttgtgcaggtgataancagactctgnctccctat

SEQ ID NO: 1357 - DNA, 549 bp, Ctenocephalides felis
ctctcgcagtatggtccttggggctttttgntaataggcgttttaatttgcggggtcatgctactgatttgcggactttgggagtgttactgccgccgacctcaacagcctagtccgcctctggtagatccttgtgcctcaatctctcctgataatcatgtggtagcaagtaatttagaaaatattagtccgcctctctatgatgaattggacactccaccagcttataatatcttatttccgccggaacaaaaaagtatacctgtagcaacaaccagtgaccagggaacgagttctggtaatattccagtgtaaatgaagattactattagtttttattttgttttaatgtgtatcacaaaaaaacgagtttatggatcttaagtcttattaattgctgaactaaatgaatgagatgccctcctggtgcatctcagtgaatgtgaagatgatgaacttaaataatgacgcttgcttaggttcaggactgcttaactgtgattcttctntcttattcangaagttaaactatcttgaaacaacaagtaa

SEQ ID NO: 1358 - DNA, 497 bp, Ctenocephalides felis
gctnatgtcatttatacgctacatttatacgcgctaaaaatttacaaacaaattttctgggtcgttaatgggacatttaacagatagccagtaactgtcaaatagtttatttattaaattgacattttttaattattgtatttttaaacatgttataaagcacataacctatatgttatagtattttttatcgcgttacatttacaattatgtatactacaaaaatagagaaaaacatgtgctctatttgtgagaagcaatatgatcgtgattgggaaattgaggaaatgcaaacaaatattgctcttgaacctacagaagaggaattctcgagacgtacaagttcccggtcaaacaaccaaataagtactattccacaaaacgaaagcaatatgatgattttagaaatgttagccaaaatgagtcatgaaataaagcaaatatctcaagaacaaaaagaactttccaaacttctgaaaaaagaaaagacaaaaaaa

SEQ ID NO: 1359 - DNA, 549 bp, Ctenocephalides felis
gaactttattaaaattcaatagttacaatttaagtcatttacaatacataattattctaaaaattcatttataaaataatagggattatttagtaaataatttttaacaatatttttaaaggtgaatcttgttttgcatctccatccatcaggtagcttattatagatcttggcacccaatgtagttcttagcgatgatttgagtttgatttttggacatatcgctgcatttttattccgcgtattgtggtcgtggacatcacttctcaataaatgattagttttatccgcatgcaccgcaatagcttgttgccaaatataaatgtttgtgacagtcaaaattttgtgttttatgaatagcggcctgcaagactcccgaggtaagactccttctattgctctaaccgcttcttttgtagatccataactttagaagtggtgcactatatccccaagctaatattccgcggacgagtcactattaaagaacgtgactccaacgcaaaggcgaaaaccgnttnaggcatggcccctccggaccatccccta

SEQ ID NO: 1360 - DNA, 549 bp, Ctenocephalides felis
cataaaaataatatatatttcaaagccctgngttatgtaatgcttataaaattcttaacaattatatgtatatatgtacatctctttctaactcaaacgactactaatactgctctctcgctctgttaccatagttgtacggctgtgcagtcacaggtctcaaatgagcccttggaagaccttgagcatcgtaatcaggctgcggaataactggcatacggcttccataccgcgtagcaggattatcgtaatccgtcgtttgagtcggcgtaggttttcttgcaaatctggtgtttcctacgactgcaggttttggcaacactggtggtggagttccgtatcctggtgaatttggattgctaactgggtaattcaagttggagccacggtcgtctggtgacttcggggcgagaatggagggtttaagggagatggtttgattgctcatttggtcgatcggaccagcgtagcattgtgttgtaaccttgtggacttgatatatatgcgtcaaatgtntccgataatctgtganggtagactctgtttctt

SEQ ID NO: 1361 - DNA, 549 bp, Ctenocephalides felis
ctgtgattatttactatgtttgtcgtcgaattataaattcataaaattatttagttttatagtgaaattgaaatattctaaaaatgttgagtaattctgatttcttaagaagaccggatagatctcacataagatcatcaagaagatatgactgtgacgaacgcgcctctaaacgacgaaaggattcattttatgaatcttttatatctcatagaactatactagtagttgaaaacaaagaagagcctacatgcaaagtttcaagatgccgatggtctggatttgatgatgaattattatcgcattgtatacacaaacacaacgttttcgaatcaaatgaacaaaatatagtcgagtttcagaattggcaaccaagtgatatctacaaaggagttctacttaaatttcgcagtttgctgttgtggttattcatggaaaatgacggtctaatattaatgtagtgncagaacgcagctgcgatgtcacgagctgtggattaggtcaatgtagctangtcaaaagatgtcaagaatgccagaatctgtaaat

SEQ ID NO: 1362 - DNA, 549 bp, Ctenocephalides felis
atttaaaacattccatataaatgtagttttttagctattgtttttctgtgataaattcccaaaaaaggacatgacattatagtttgaacaagctgattttatttataaaatataatttattgtatatggatgtgtgattgtgttaggtattgcatgggtaaattttgtttttaaatatcttcaaaacagtttgtggtaaaatatttaatttaggaaatattgttatatcatgaatatgccaactgaagtaaatcaaatataaaggcactttgtttagatatttaaatatttaaaatgtttgttaaatatatatatttgttatttaaatggcctgcaatattactgatattgcctgttcaaatctctaaattctagtaatatatgtcaccattcatgtgcatttattcaacgattgttttatgaagctctttacagcttcgcttatagttaaaatatttagcctaacattattaatgatattatcacattagaaatctgtgaaaatattgctgntaaaatgtatgtgagtttaaattgcaatatccactc

SEQ ID NO: 1363 - DNA, 549 bp, Ctenocephalides felis
ctttgacacatctaaaaattattttaatttacaaaaaagaacttcataaatttaaaagagagttaaataaaaatttaaaaaaataacactatttaaaatgcaatatttaaacatattgaataaaataaacaatgttgttagagttaaatatttatacgccacataggttttaaataaataaataattattttaaaaaataatttatataaattactttgaacaaaatctagcaataagtaaaaatgggttccgctattaaacaatactatgcagcttttgtagccaacatcgccacaatctgctacggcaccacaataggctggtcaagtccagccctgtcagccctttcaacatcgaacccttcaccaggcaaagacatcatcttccaattaaccgacgaagaggcctcctggataggcggtttgatttgcataggagccctttttggaggcctttgtccgcctggttggcaggagtcaggggcagaaagttgtggatatatgacgtcgnccatcataatcagtggctttgctctgttgcgaattgtc

SEQ ID NO: 1364 - DNA, 549 bp, Ctenocephalides felis
ccattcgccgtattttcttaacaaaacaatatttatacaaaatttatgttcaataacactgtgtaaacccataacttattcataactatgacagcaagtagaaaaagcaagagttgtgctaattatacgatgaagaaagtagcagccgatcatggaaagttcctaaataggatcaccaaaacgctttattatggaaaactaccgaatactgatcgttttagtatacccatgtcagaattggcagtggagatgttctccgaagcccatcgtggccacactctgcaaagactacaaatgaactcggcttgcaacatatctcgaaatgcctgtgtcaacccctgcgctctcgtattggctatgttatatttggacagactacgtgattgcaaccctgaatatgtgcgacaagtagcccccagtgaactatttcttgatctttgatggtctctagaagtttttgcatgacgatggagctgaagatgaagtatttttacacgaatggctgctcagggggtattcagtacagcttaaacactagaaaaagattct

SEQ ID NO: 1365 - DNA, 549 bp, Ctenocephalides felis
ataaattcatataattaaatttgtaaattttgaagacatttataaaaccaaagtatttatttcaatttaatacttgaacattaattttaaaattgattaaattataaagtaaattaagataagataataagtatagagtttcgtgattaaatataatagtttttatatttttatataataattttatcgagataaaaattgataaaggttttttctttggatcttaaatactatgaatacctaatacaagttatgtattatatatttaccattgaggtaaattttaagcagttttgtcatttataatatgttgaagttgatttaacaaaaaattaatcgtccttatgtaaaacaatatataaaatatttctctagaaccaacctcaatgatttttacaggtatataacaaaataaatataaatacaaaatttatattaagttgtaacatcaacatatacttatattaatatctgaaaaattatatattcataattattaccctatctacatattatatcctgtctataacttcattcaatccatattgg

SEQ ID NO: 1366 - DNA, 549 bp, Ctenocephalides felis
attttatgcgacattttgggttatatgatttttaaacatctgaactgtaagtcttttttcatatagatttattaaaaagaatattttaaaaattgaattcttcctaaactattgctaaggaataaaaaaaacatcgtcatacatttatatacttagctaattactgtaaaattgtaagaattcattttataccttaatgattaaccatattccaattaaaacacttagaagacattaaaaaaatcaaaagcactaaaaactgttatggaaaatcgaaatatatgtctttgctcttcagagcaccggttaaacaacaatcaattcatttttttttaaagattattcatatattttgggtgtcaatgatcttattagtttaaatatttttgcatctgtagaattaactgcagtagtattttgcaatgcattttcaaagtttataatgcgttttgaattggaaatgattgncattaaggtgnaggtgaatcttcatgtataatattaaataagtatctaaatgtttttttggttattatcaatagttttggn

SEQ ID NO: 1367 - DNA, 371 bp, Ctenocephalides felis
gttatgaatcaatggcatcacctcaaagtgaaacttctattacaagcagtgaaaattattgggatgatagactttatgaattgtttccagatttggaattctaacagtttaaatatttacttaatatgaaatcattcctatttttatattgatatttttattatgaataagttcataatggaagtaccaattgtttaagaatgctatgccatcattcgcctaatattagtaatatatgaaatcaaatttaattatgacaaataatatataatgtttagcatgtcatatttatttaaagtattttgtatattattattacaaattaaaaatagcttatcaaataaaatatatataaaaaaaaaaaaaaaaaa

SEQ ID NO: 1368 - DNA, 549 bp, Ctenocephalides felis
gtcactggttactggtcactggtcattaacggcgacacgcacgctcgttaatttacaattgtcctgaatttgatttttttatttggcggttccatgagtgattaattctattaaattagtttgtgtatacataatatgtgtttgtaatgtacattggattctgattttaacacgtgcttgaaccagtatcatccgagatgttgacaataaccagtacttagaattatcagtgccattaaagattcgtttgtgcagaaatagacggaaaaagtaattttaatattgttagtgatttttttgtaacttatttgacaatgacgagcacaattggagtgggttgtgacattcaagttgtggaacctaaatcttgttccttaccggtaccacaagaacctttaagggagcctttaccatcagacaatggttcgttttatagtcggcaaggtcccaaagtgaggcgctcacggattgccgaagaccctgtggatatacagtcaaagacatcaagatgccgctcgctgggttcaggaaagggataaagaaatttac

SEQ ID NO: 1369 - DNA, 549 bp, Ctenocephalides felis
aacgcgctaacaagcgatcacgaacccaatcactaatagtacgatcagtaagtgaatcacttcactagtgatataaatggtcaccgattaaacgatttaccggtaaagtgttcgtgtgagttattaaagtgtcggataacaaaatcacaggacgaagcaagatgaatttgtgcgtgccactcttaaatttattgatcctggcgctggttttgatagcgcaatgtcatgcttcgaaaattccggagggaatgcctttaattcttccaaaagatgccacaccttcacccttattgagagatccacccacaccacccctgcttctcccaagggatgcgactactccaccaccgccaccactggtctttccagaagatgtcaaaaactacaacatcgtaccaaataatgcaacgatcttggcaactttgacgcataaagacgataccaatcaggaaagcgctgaggataataatcaagaaagcgatgatttaaataagacgcccggtcagaggncctgcaaggaagtgtatagcacagaagtacagagaggtt

SEQ ID NO: 1370 - DNA, 549 bp, Ctenocephalides felis
gaagaaccagggatattacaccattcataataaattatattgcgatattcacgccaagctcgttgctcgccaaaatccaccagctggtaccgaaggatgcattccattcaccgtgccacccggcggaaaaattccggtgagcgctatctccgcagctctggctgcccactcgtctcatccacttaatggaggtatggcaccacctaaggaccaagcaccctctaccccgggatatgcaccagtttcagcaccaacatgcaccaatctgtgtgttcaagtgtctccttcggccgtcaatgatactaaccagcctaaccaggttacatacgaatccaaccttctagtacagattgctcccaacgatcccacatatactaatgacgaaactttagagaaacaacggaaattgaattcaccaaaaagttcacttgtgaactatgtgaaaattactccgtataataacaaccatgaaactagaaattcacctacctcgattgagcacacacatctctaaatcagaaactaatcatcccgaatggactgtattaa

SEQ ID NO: 1371 - DNA, 550 bp, Ctenocephalides felis
caaacttattgttaacataaaccttaccacttttacgacctgttcaacacctccaatctgaaagtaatgtcgatttaactcgggtcgtataacacgttgggtatgacggtggcagagacagaaattgtgcaatcagaaagataattcggaagaaaaaatatatttatatatagatttgaaactgtcctgactacgaaatgtaacaaatattatgatttacaagtatagaaacatggagtgcctagcttcaccaagaaatctaagattcaaaataactttatggacaaccctatatgtagcagaagtgattatgtgcaaggagaagaaaactgtgactaaaaatattgtaaacatttagtattaacaattgatatttctattgcaactttattggtaaaaaaccaaaattttcactactattaatttacattaatagctactaaataattcaatcactctaaagaatgactgttttcgatcctactccattcatctataaactggtctatatgcaaagtatgagacaaagaagtttactgtccggtgtcgg

SEQ ID NO: 1372 - DNA, 550 bp, Ctenocephalides felis
attttgttttacattaaatttttcaaattcgatatgaaatttttactggcaatttgcgtgttgtgtgttttattaaatcaagtatctatgtcaaaaatggtcactgaaaagtgtaaatcgggaggaaataatccaagtacaaaagaggtgtcaataccatctgggaagcttactattgaagatttttgtattggaaatcatcaaagttgcaaaatattttgcaaaagtcaatgtggatttggaggtggtgcttgtggaaacggtggttcaacacgaccaaatcaaaaacactgttattgcgaataaccatattccggatgaaagaccaaattgatataaattactaaaattatgctagatagcaatcataaaattttgaagttttcaatgatcctaacatgttttgcctcaatttattttaacagcaaattgtggaactaccgtccgtacaaatgtcaagaaatctgatgttacaatagatattataatatgtacattgctatattatagaatatatactgattgcaagttgaaaaaaaaaaaaaactgn

SEQ ID NO: 1373 - DNA, 550 bp, Ctenocephalides felis
gcaaataattctgtgttgatatatcttgtcatattaaaaacaagtgaacttgtgaaaatttgcaattaatttgggtgacaataatgagacttattatatttatatcgtgcttggcatcaagtacggtttaaatgtacctatagtcaaaggcataataaaaacgctagtggaatttgcaccaagtgttattgtataaaactgcaatatgatcaatataaaaagtatatgtccttatttttttgtttatattttactttcatcttatataaacactattttatgtatcccggtaccaatgaggcgctgtgcaaagttatacaactcaataagtcctcaagcctcggcagagtacgatgagaatggcgatatatcaaaagatctggtcgaaaatctcttacacaggtgtagaacaatgcacaagtaattttgtactcttgtgncggaaaatgaaacggtctctcatgtatgggcanggtgtggggaactcaaataaanaantngtntcccaaanaatgnttacatgnccttttntaagcntttatccaagatt

SEQ ID NO: 1374 - DNA, 550 bp, Ctenocephalides felis
taancaaattcgttagttttgaaacaaaacattnttttaagctttaaacggattttttatcacctgaggaaatcgatttatacaatttttggaactatgcgctggtgttctcacttttctgattttttaaacagttntgtgtgagatatnaggntcgtaggcctttgacatatatgccgnacnagatcctcccaattttattattggagnnggtcctaatttanttaccccattccaaaaattttaaatttttgccaaaaatgcntttctaccatggttaaagctcaaatatccggacttttttattgccttattattngatgaataatttcgattatttgatttcgatncaaaatctaaatgaaccagtttaaatccaaatcaaataattgaaattatttgtaacaaaaaaaaaatttataatcccaaaaatataaaaaatatttatttctactcattgaacacaaaattcacatagaaaatgngcctgtttgctatacaatatagattaaaatntacgtncgtattttaataatttttgcatatttat

SEQ ID NO: 1375 - DNA, 348 bp, Ctenocephalides felis
caatagaaattaatgaaggaatgaaaatttattagttatgtttgacctcatctagtccgttgactttggtttaaaaatataacgtaattgagttaccagtatgttatatgaagaaaccagttttttctcaggttagtaagttatattcttgtttgttttgttaatcaatcaaacaactttgttttactgatagttctctaaaactgattaataataagcctccccagtgagttgatgtcttcatagtaataaagtgctcttaatactccaagttttatttacaaaactagttttttttgtaaattgtgcaaataataaatgttactgttcaaaaaaaaaaaaaaaaaa

SEQ ID NO: 1376 - DNA, 155 bp, Ctenocephalides felis
gcattgtttaaatatttttcgattgtataaaattgaattataatgccatgtgtaaaaatataaaagttatgtatttttaacattatatttatagatatataattgtaaataaaaataaattctgacactaataaaaaaaaaaaaaaaaaaaaaaa

SEQ ID NO: 1377 - DNA, 550 bp, Ctenocephalides felis
ctcnntttcagttgaattcttctattcgtcatattgttttacatacaaataaatgcaatgtgcgttttgtaacgggatctgtgatacttcatacacacatatgtatgaatgatagaaaataacatttccaacgttcaagtagatactgtatgtagtttagtgtttgtgacggaattcctgcagatcggaaattactaataattacctgtacagttggacattttcaatcaaaaaatgtactggttagctgcattattgcttttgtctacgtgctcagtgtttgcccaatttaatcgcaacatttcccaatgctgcgaagaaagttgctacagtactgatgaccaatcccaaaatacaagatttgcgactaaaactgcttatgaattagttaaaggagtcagaggagatctgacagggttccacattgtgaacctgtacagttctggttgctgccagacatggtctagctgcaactgccaagaaatagcaggatgccacatttggaagtttggagatgagatatcgaaattatcaagacagaaatctggct

SEQ ID NO: 1378 - DNA, 550 bp, Ctenocephalides felis
gctgctggttaaatattgtcaaggcactttaatttattgttatattacatttgtttttatttgataagttaatatttgattttattattatttaaatgtgtggcaaaatgattagaataatttattcaaacctgttcgaaaattctgccgaagtaagatgcctacgtattcgtcatcattccgtcatctttgctctcatttgctgtgcaaacaaatattgtgaaagcagaaatgaaatgaagtaaggtgttctggcgcggttgttgtttatgttagttttgaacaaatattaagcgaagtgaaatatcactgttgatgaatatcagtcatgttttgatatatagttaattaataatgatttactttgatatcaagatattgatatttaattaatgacacttttattttgcgtgcacgttctatgtttcaaagtttatacacattttgatttgcttgattattgataaatcatgacgaaaagaatcggcggcacttacgtngacgggcatactagcaagggcaggaaatcatggaaactgttaggtccttc

SEQ ID NO: 1379 - DNA, 550 bp, Ctenocephalides felis
ganntttctaaacaagatgcctncaaacctgatggagctgaagcgaaaccggatctagaggagaaatactgtgaaataaaacttgcacaaccagaaattccaacttcatctcagaccagcgaactaggtccagcagtgcttgtggaaaagactccagaaatcgggccagccgtgttggtcaagaagggtaaggctgaaacagagaaaactctcgagttgggtcctggtacaatctcgacggttgccatttgtcctaatttaacagtcgctgaaatttacaatgcccctttattagcagcgagcgaaccagcaaaaccaaatgttcaagctgatgtcgctccagtcgattccaacaagccatcgactcaaccgacagaacttgtagccgcggaagctaaacctgcagcgagcgaaccagcaaaaccaagtgttcaagctgatgtcgctccagccgattccaacaagccatcgactcaaccaacagaagttgtacggcggaagccaaacctgtgcacacctaagaggttctaaacaccagtgtatcgaggca

SEQ ID NO: 1380 - DNA, 550 bp, Ctenocephalides felis
gaatttttggttattctaaataaatatatttaaatacgaaatgctgagcaaatagtaatataataacaatttattttatgttttattaataaattacacaatggaacaactaaataacgctttaaaagccataaaagtgctccgttcgagtgtcggacatgtttttgagactttgtcagaaggtttaagaactgaacatggacaagatactaaagacacaaagtttttgattgaattacaagaattgctgagtgctgttaatgttaacttgagagaggtagagacttcagtgaatagtttaaatgcgccccccgggccattcaatttagcaaacactacttatttaagtcaagagactacacaggagagacaggctttgtctcgcagcttgtaatagtatagtggccgataagattcatgagtcnaggncctacacagctttttaagtcaaatgctttgaaaggcatnnttaatcaagcatgcgaaaggcggnggacccaactttctttacatgtgccnccgaaacgnggttctttatacaagttttcag

SEQ ID NO: 1381 - DNA, 550 bp, Ctenocephalides felis
aatctgtggatagttcatttcatcgtcctccagtaaaatcagcaaaggctgaatagtgctgaagttgctgcttgtaatactgattttgccattcaattggaataggcatattattaagcaaatgaaaaaagttacaaataattctaattgaactcgaaatattgtgtctaccatatggaaatcaattgcatattgtagttattcagcagttcaatgcatttttgaaatgacatttcgtgaaaatttagtattagtagtatttcccagtgagtgtctataaaactaaatagttcgaatatttaaataggacttcctaaagccatttttaatagcttttattccgcatagtatttattaacttatacctccagatgcaaatattggtccttatggtaatcctcttatccttattattcctatgtaaatatgtaaaaattggttataaggaagnatgtttattatccaagtttagatattatcatacctattatattagactgtttgtggcatgctttganaaataataatatggattatctattaatctgtc

SEQ ID NO: 1382 - DNA, 550 bp, Ctenocephalides felis
catctgggaaattaggcctggagcaaggattatctcctaatgtttgtccaaattcaacataaaaatatatattttaaaatataccatgattatttagtagctggagagtttgaggtaaattttaatgatcagttcattgtttgaaattagttttgaacacagacaaaaaaacaagcagtttgttgatatatttgaattcaaaacaaacttgcaattctcgattgcacattaaattctgtttttttttctgatcacggatgaagagatttaaaaatttgggttttgggagtgttacaaaattcgctctgagaatataccgcgcgaattctaagttgtttactctaatttatataaattatattagaatgctaagaatgaaagcagtcaatccctaaatataaaatgagaaatagtttagttttaaaggcagcgtactcaatataattataataaacaaaacaaatttatctcaatacaacccgtaacgaaacttttatgtggatttggataattctttgggatatcggaaattaaaattcgatagatattt

SEQ ID NO: 1383 - DNA, 550 bp, Ctenocephalides felis
ggactaggagcatgaatatgtatgaataatccaaatatattgggttttattatttttttattgatattaattttgactatttatatttgccataaagtgaacttatcaaaattagtgtcacgagaaaataatttagaaatcatggggtccattaaacaacctggcaggtttatgaatacacaacaaaatgcacagaggacaacaaaagctcaaggtggttttccacaaagcttatctggaagtgagactgatgtgtccacatccaatgagaatttatcacatgaagagcgatatgttatccgtcacactgcacgtgttgaaccacaaggtcaagagaccttgcaaaacccatcgccaagtcccactcaaagcccagtgattaatcgattgaaatcaccaaatcaaaatgtacaaagaaaattggaatccaacatccgagaccattgatatgagtagaaaaatggaagtattaccagtccaataaacatgattcaaattatcgaaataaagagctccatgccagaatcattgcatatcagaatcgagaatn

SEQ ID NO: 1384 - DNA, 550 bp, Ctenocephalides felis
aaaactggaacacaagcaattatttcttaagattaaattgattgggttcacatgcaacattttaaatactcgaaacatcgatatatctattgttgcaaattaaatactgcgaacgatgttgttctcttttcattattttggttattgtcataacaacataagaataaaccttttacttaattgaacaggaatggaaagtatgaaaccgtggttttaataaaagtaagattataatttaatgattagaaccacttttgattaaatatcagtaaatgtaaaagcctcgtataaaacgatgatatgataacagataaggccaatatagtgattaaagtcaatctttagacagtgaaaagtttaattaattgtttattctaaaattaaaattattattcaatactatttaaataaatagatactcataatacaaatattaaacataaaataattcttgtaatcatgagtataatgaatacttaatataaatgggttattaataactaatatcattatataattatatataattggattcgagtgaaacncatac

SEQ ID NO: 1385 - DNA, 550 bp, Ctenocephalides felis
ctttngttagttagttgtgcaagaaaaattagcatttggtcatttccaaagttacatatggtttgtgcaaacttgatgcaagttgtcgacgcgtgtagaaatggaaaaatggagcccccttagcagtcccgagcagctaatcgagtgacatttaaaagggcgcaaacgttacatcggagcatgaatagcaaggtggaccctttgccagacgagcacctgattattctgaataaattatccgctactgaatcaacattcctcatcgcttttaatccatcaaacaattcaattatccacttctgaatcaacagccctcatcgcctttaatgcatcaaacaattcaattatccacttatgaatcaccagccctcatcacctttaatgaatcaaacaattcaattatccacttctgaatcaacagcctcatcgctttaatgcatcaaacagtaagacttatcaactatctatcaggcaattcaattatccacttatgaatcacagcctcatcaccttatgatcaacaatcaatatcactataatcacagcccta

SEQ ID NO: 1386 - DNA, 550 bp, Ctenocephalides felis
cttcntggtacgggttggtcgttggagttcctttggccatagtgtttgcgattgtgattggcatattaggttatatattctacaaaagaagaagaaacgggtgcgactacagggccgcagctacacattgatatagaatcaaaaaaaaatattcagaagaaaaatataatttcatacagtatagtaaatgtataagtagttaattgtagtaatatgtttgtttatggaacttgcatttatagattttttaaattgaaaatcgtttaaaatcaataataaggctaatgtacttgcttaccaaaataaaaatatcagtaagtattataaaatttgatttaacaatttggacaaattgcttaaaaataaaagtcttcgaatatttttggctcttattttcatttatttcattttattttttggtactaataangctggtatctctaagtttatttcttatccagagattttaaattaaatttttaanccaaaattatgaatggttttaatcnctaaaataaaaaccaaaatttatggtagaataaattttttt

SEQ ID NO: 1387 - DNA, 550 bp, Ctenocephalides felis
tnatnnngtncgagattntgtattaantatatcgatnnttttccagtcgccaaaatggngttgttgagtaaatttaaacctattgatactacttgtattgaatatgtgcacccttggacaaatagttgttctgatgcctgtgctgatttaacactnnaggctttcgagaggnccatnaaaatatatacagttgcatatacagncggactattgatgcgaggcaaagtaccaaataaatcggacttaagaaagacttttctggggattctacaatctgcagcatttttaacgacaaatggttttacattccctatgtttttatgttttctcagaaaagtttgtggcnattacaatatattgacagtctcatacgtgccttcgtttcttgcatcgtttgctgcaatattactagaacggcatctagacgaaatttattatgtttatatgtatcaaatgaagcaacaganactgttggaatatgttgaagtctaggggatatgtccgtctataaaatatggagaagtgggaatcnnttcatgagcatcgtatt

SEQ ID NO: 1388 - DNA, 542 bp, Ctenocephalides felis
ganttgnattcatgtttactttcccatctganncagaatatcagattgttgttttaaagttaaatttttaacgtattctattaaaagatgcaaagaaatatttccttaactatattgaaaacaaaacacaattatatttgtatgtgaattatctctgcttagttaataattaaatttaggtatagacaccactaggtataaaaaaagctcaagatttttgtttctagtacattttacttcaatttctcatatttgctccatttccataaatcgtatgtcttcaacgtaaaatttcatcagatgcgaaacattttcaacaagaacaaaagttactattcagtttctcggtcttaatttaataagccattttctatgcactgacttccaattttccatgtttttatattataatttgtatctatttttttgaacaagtttcgttcaaactaaatcagctcgtagtttttcgcaataatgcccaataatttaaactttcgaggttgtgcttatgggtttgacactagacaattctttttgagtcc

SEQ ID NO: 1389 - DNA, 542 bp, Ctenocephalides felis
gccgtatgcacgtcaggtcggtaggcaggaataaaaacataaacactggcaaattgaaacgtacatttgctacatttgtcattatgtaatcgagccagtgcgatcgcacggccgtacgggtctgcagcattcacgatcagtcattgatgaggtgtcgtattgtgttttgctgtaatattagttatatatgcgaagcgttctttacgccgccgtcatgattattgcgaagtgatttcgctgagtgtaccgccgccgtacgcacggccgcgggccggtgtgcctctggacacgctaagtgcgccgatcatctccgccggttacctggtaatagtaataacaatttttatgcagaactcgataacgaatcgaagtgggttattaagtgatttattagtgtgtgcagtgtttaaattgaaaaattgcagttttcttatggtaaagtgcagttttaatgttaatgtgtgttcaatctgtgggtaaattatggtaccggtaactgctctattcatttatataaacattttaatcaaagcctaagacgn

SEQ ID NO: 1390 - DNA, 542 bp, Ctenocephalides felis
actctattagcgatactattataatgtaaaaaagttacaaaactttgaaaacgaaatagatttttttatgttcgttatggatatatccaatgtcacagcacatgtaaaaattacacacgacaatgtaatgataatatttaatcttaatttgaaaagatattgatttatgaatatgaggaagctgtcacaagcagtaaatcgcgttgtctaatactaaaatatattatatcactttatattaaatttcattctcatttcttataatccttaaatgtttttatagagactcttcacaactggatttggagcagaaacatcagaagtacatattattaagtctggtgttccacaaggaagtactctaaagccaattttgtactctgtatacacacaaaatatttaagtaactattgaaacttttgccgtatatgcatttgtcatgaggattcacgaaagtgcatcggtggcgacggcaaatgtttaacaataatatgaattagtacttaaaaagtagcttataagtagaaaataaaaanaatgaa

SEQ ID NO: 1391 - DNA, 542 bp, Ctenocephalides felis
gccgactcatgtctcagtttgaggttagaatttattaagtgaaaacatggtcccacggtcgcagtgttttacttctattttggcggttgcgcccaggctgttgccgttcctgataacagcggtttcatatttcgtacttgctcttccgaaggatcagccgtctgttctggcagtgatagtaaaatgcactcctatttattgtcttatttattttgtgttgaaagctggagtatccactaataaaaacaaattggcattggcacttgttttttcgagtattggtgatgcttttctggtgtggaaggagttttttccacacggaatggccgctttcggtgtggcgcaggtgatctattttactacttttgggttcaaaccattaaaacctgttttaggtgctatttggtacttagtaggaactgctttggttgccctagttttttcaaacctcaaaggcatttactgtatggactgccatctaccagttcttttagttacaatgctttggagagctccgccagacacagttgatgataaggctg

SEQ ID NO: 1392 - DNA, 542 bp, Ctenocephalides felis
cngctatgatgatgaattgtgaaccagcttacagctcccttttgcctgattatgaagaggctgtcaaacaatcccaggatattccaccaagttatcaagctgctgttgctagcgctgggttaattgaaaaagaggctgctgcttcttctgctgatgcaactgaggaaacgaataagccagagactgagcccgccaagacacctgaaccggaaactaccacaaaaagtgaaccccataatgtgtaaagtaaaaaattaattttaaatcaactgaaataaattgcataaccgaattgaaattttcatctgcatatgcatagatggcaattagctgacagacatattttgaaaatataactacatatatgtattaaacaatatataagggcatatatataaatatatatatatatatatatatatatatatatatatatatatatatatagaatatctgaattagttttagggggagatatatatgatgttatatnaaannaaagtgtntctatatgaanaanggggggngcgatattttttaaa

SEQ ID NO: 1393 - DNA, 542 bp, Ctenocephalides felis
gantagaatgtattcgtgaatatcaactatacanaagattttgaggttagaaattgtaaaaaaggggttttgccctatatttaaatataaaacgatatagctaattattagtggaacacgactattgaacaaaatcaaatgcaaaaagtaaataataacgatttgtgatgcttgaactgtgattcaaaatgtgaaataggaaggttgtaaaacgaacgtgacgtcttgtgagtgtgtttctaaaactgtgtcagtagtgttttaagtccgatataaaatggatgaagaggagaaaaagaataatattggtacacctaaacataattccttaataaatagtaccggaaaacacacttctgtaacacataatggcgcgaaacataattcacctatgatcatcaacaatggcgtaattatttcgcacaacgattacggcagtatcgttactggaaggagatcgcgaaggattacatcaatggaaggatggcctatcttctcaaaacattgtcctggacttcggcgagttatcatcattgatgata

SEQ ID NO: 1394 - DNA, 542 bp, Ctenocephalides felis
ctataattttattattactaactatgcctattataatcaagaaccgtttaattcaataaattaaattatataagtagcgtaaaatatttttcatttgaaacatttgtgttcgaccaagatatttatgttgattataggtaagagaatactgcaatgatgatggtgtccttttaatatgcttctttatattttgtaataacttttaacttcccgtagggtaagttatagttatcgcaaaaaatataaaacgaatttttttttatatcttcacgtttcagggtttctgaacattttggccatagataaattggcacaccttagaaaaaatggatgagggtgtgtgtatgtattggatacaatttagtccacgattttgggcgcacggatcaaccgatttgaataattcaaaaacattatgttcttttacataaggagacacttgctgattagttttttccaaaggcaggtccagcggtttcggagatccagaacagaatgtttttaaatatgccatttgacggtcgaaaatcagtattgactgt

SEQ ID NO: 1395 - DNA, 542 bp, Ctenocephalides felis
ctttattagtcaacggcactgtccatccatngatcatcactacattttattctcgtttctcccgttgttgagttgtttttgtttagttatttttagaattaagtttgtgcaacttttatttcaagtgaagaagcagtattatattatggttataaatggcattgcatgtatgactcacaaaaattaaagaagtgagtgtagcgattgatgatgaattagaaaacgggtggaagtattctgaaggtgcacaagatttgagtgattcagtaaataaatcatccaaaaataagttgaatgactacatgatggcgtcccaattgaatccagaagctgccgagtttgtaccggttgaagcgggtagtcctgcacgatcagtattatttttgagagaaggcttgcttgatgatgtaatggctcgaagtccaagacaatttagtgctgctgaacaagttcttaatgtaccatcggatactgaatttgcatcagaaattaaatcangaccaggagactaagtgcaaatggttcttttgaaagcgataaga

SEQ ID NO: 1396 - DNA, 542 bp, Ctenocephalides felis
cttactttacccacacaacctgcagctcctatatttatgtacaatggaaacattgatttcaagcctgatacattactaaaccaaccacaagtgatatccttgcaaaaccctatagtaaacaaccaaaacacacttattttccatccggtacaaaacaatacgttttatgatatcaaaacattctcacatgccccgacaagaaatgtaccaattgcaaaacagaaacctggtcgaaaacaactggcagctcgtcagactacaaataatgtgcaaccacaaaaaatctttgtgcctaatatgaatacaatgcaggacaagcaacatgtattattgcaagcaaagttaatcaaatcggaacaacatataaacaaaactgttatgtatactactacaccaattgctgtaatcgatgacaaattggctatcaaagatttgtcccataaagaaccaaaagtgaaagaagtcaaacgcagtgccacaatgctatagaacgcagatccggacaagtatcaatgataaaatattgactgaaaatatgatgg

SEQ ID NO: 1397 - DNA, 542 bp, Ctenocephalides felis
gtgcctttgtcgccatattatttctggtcatngtatttttggtaggattcgcctatgtgatgtaccatcagaaaattttggccaaatcctattttgaaaaagtgcaatttaataaaatgaggagatctttgaagatttatgatgataatggtgatactatcattagtggagagttgggtacaaccctaaggtctgatagggtgtttccttgtcatgccgaggatatgaacttttctgaaaggaagagtcccctatgcctagaatggctgcacagtgcccgtctctatctggatcgcgaagaagacgcttccataatatcctcgcacgtccattccatatccacatccagtggttcttcccaaaattccaacaacccaaaccccacacattccactttgaaatgctatgacgtctcctgggttgcaatttcgccctaccattacccgactgactgttaccagtggactgggcctgccattgcttgcaaatgatacaagagcttcaaaccatttattactgggaaaaactggggaaatgtctga

SEQ ID NO: 1398 - DNA, 542 bp, Ctenocephalides felis
aangtgcaaaatgatgatatcgattttactatttacatttttgagtgtatttcatttaggatcatccctacaatgttaccaatgcgacctggcaaataacccggcctgcacggcgtctctaaattccactaaagacattgcagccgtagaatgcggaaaacttcctcaacaagttagtgaaaatgatcgctccttaatacgatttttgccaccaaatttcgatggacacttgtcaaccaccagggaaggagtcggatttcaatgcgcaaaaattgttgccacgaataacattcagggtggttataatatcacgagaattcttcgaacatgcattgtcgataccttaaattgcgagaaaattaatgaagacttaaaacaagaaggattttcttcaatgatgtgcgcaacttgcaacacaaatttatgcaatagttctacttctttaagcatcacaattttattaccatttatattatttttaatcacaaaagcccgtcttagggaaataatttgagttagatgaaaattttcaaagtctttca

SEQ ID NO: 1399 - DNA, 542 bp, Ctenocephalides felis
atnaatgttaatgtattttaattaattacatgtcattaaaatattgaacagttttagaaggttgtaataaataaatcaactataattttagtgtgcgcaatgacatctgtcaagttattttctaatattctgtctaaataaatgagaaaaatccaaaatgttcaaaatggagggatgctatttgtcaggagggggtatgtaataacagctatctgaatcgtcacatttctcatagcattctggtggtatagtgatgggttctcggacaggagcggggcaaataggataattatcttcaagttctgaatcttcagaagattgttccttttctataatttcatcattttaatttaatttgtttgcacacaataaatggtttacaaattgaaaactaatgtaaaaaaattatgagcaagttttctgaaaattaaaaataaaagatgacttaatttagtatcagtgtcatcggtttatggagtaacatccaatcatgcaaataaatgattaattatgaccatgccagagacagatttcacatgaat

SEQ ID NO: 1400 - DNA, 542 bp, Ctenocephalides felis
attaccaagggagagggggttccagaaatccttaaaaaatttatcatgtgaccaatggacgcccccttaggattaatatgcagtaaaagtttttttattcttattttattttaaaaaaatgacaatgtatgtggttccacaataaaaaacgtaacgattctattttattaccttatttttttgtggaattttgtgaaactatttcacaaaatttttgtacgatttatcttcttgctttctgattgtatacttttgatcttagttttattccacaatttaacagcctcatacaaatgagcatatggacgtgatgtcactattttatccacttaaaaaaaaatggacctgaaaatagatcgagttctatattgttcccattttatccaaattgacttcccatcaaagtcggtggtaagttcttggttaaagatttaatggaagctttttgtatttttttttcttgtggaatcgacatttacaaattgttgactaaattcctcttaatttcttaaattggaatcagctcataaatcaatgtaaaa

SEQ ID NO: 1401 - DNA, 542 bp, Ctenocephalides felis
anttcggttgaattgtagcttcttacttgaaatatattatcttgtgtgccttactacattttgatatacaaaacattcgattcatgaaagatcattccataaaaaccataatgtatcagtattatcaaataataaaatttttaataattttaactaccgctgattatatttcattgcttttttgtactgtgcagcataatttaataaaatataagcacctaaagcaagtcatatacagtactacatatgttgaagaatttgatgaaagcaatcaatttttgatttgtaattgatttaaatatattatgttaattaatttgaatatatgtattagattatagattgttcattcgtattgcagaaatacgaattgaaaaattaattatttaattaaagatctataaatttcgtccaaaacttaatcactgattcaaaatttgtgcagtagttgcacatatttattttatatgtaatttagatgttattttttgcatattcaataggatagcttttttacaaaaaatattatgtaatcaatataa

SEQ ID NO: 1402 - DNA, 542 bp, Ctenocephalides felis
aanaaacgagcccactggctgtctatcaaaaaaaaaaaaaaaaacgagcccacccatcaaaaatttggttccgacgccactgcatagattctaactaactaaatacataaaatacaataagtactacttactttatatattattaagtttacttacaacaatatttttttatttattactttttttatattcgacttctcagattatatatattattaaaatttattattcgatgtattattacaatcgtgccataaattaaaaaatatgagtatcgcttgtaaatatattagttaccagttagatgtaatttttgtactctcaaattttaatcgaaaccaaatttttgattattattaataattgataagtagttttaattaaaatagttggacgtttgcatctcagataaattatattaattattttataagttatgtatgcattgtaataagtcacacttctataaattaatttttaatcaaattcttggtataatgngaaaatttaataagctcactatatatttatgcttatatata

SEQ ID NO: 1403 - DNA, 542 bp, Ctenocephalides felis
atgtcgtcgaaatgggcaaagtcggctatcaaatcagagttcgttggttggtgccgtcgcgcttcgacttacttttatttcatttattaaacgcacgttcattcattgaatcggaaaacatggatatggagagacagtcgcttcatagttacactaaacataacctaaaatattggtgtataactaaaagataacgatattataatgtttcgagtgaaatttttgttataagttctgtgtattaaattaaataatagtttagaccgaagatatcacatttgtgtcaaaatgccaaatgtcaatgtgacaaacggtgcattaaaatgaatctcataacctctgtgtatattttggttcttagcaaaaatttagtgtacgctgatagtggatatgtgtaaattagacgttactagaaatttttgattttaataatgagtattggtaaaatgtgtacgcaaacgagcgtctactagttggacgtatgtgataatggctggtgtcggacatagatctagcaacgctcacaaaagacgtcttaacga

SEQ ID NO: 1404 - DNA, 550 bp, Ctenocephalides felis
acaacatcccataataaaagcattgtacagcctagtggtaatgatcatattcgagggggtaatgttgctccacctagaatgcaagatgttgtccgtccaaaaagatattcttgtcaaagacctggtggtattgtaccagaaacaaacatgcaaggccaaccgcagcaacaacaacctgtatatcaacagaactactatgcaactgaatatactccgcctgtagcaaatgaacaaaataattcacatcaaggacaacatataccacaagcactaaatgggatgccccaaccagggggtcaggttgtacctcctaatatttctgtgccacccccgcaaacaatgccttatgtaccagaaccagttcctacacaggtcataaccactagtaatcaagtgatgccgcaacaagttcttgccctcaatatcctcaagttctatgcagtttaattcgggaggaccctacatggctcaaataatacttttatccacaatctttaggtatctgtcctctctaacatgcaccccacacaatatctcccaatccctcata

SEQ ID NO: 1405 - DNA, 550 bp, Ctenocephalides felis
cacatatttttcaacatggaaggacgtgtgtgtcgggctcgattaaaaaaaacgtggaaattaattatctcataatggtgttagtttcgaaaggctatatttatatatgtagacgccagcctaccattttggttgatggcgatgatctgatattacgataaggaaaaatctggaccacgagataactgtaaccgcgccagttaactcgttcaggatgtggtgtaagtactgccttcatatattcctgataaataattttcatgatgtttatcgtgatccgagggctgattgtttgtgaatgttaactctttgactgaattaatgaacaccctctaatttattatggaaatctctacaatcttgtaatatttacatgattgtattacagtttatgctgtctgagcatagagaagcacctggaaccataaatggcttcttgaaaacatgcatcacatctcatgtctacacatgtatcctgcattgatgagaagggtgtcaaatcacatccatacataatgatgtacatatatcctgcattagtgaagagaga

SEQ ID NO: 1406 - DNA, 550 bp, Ctenocephalides felis
cnacattgcatggnatactgtnntcttnngcgggnttnttggtnngggtnngtngatnggnaggnttgnnggctcgtnacnagacncnttgnnnncgntcaantagcccangattngtttctcacannattgntggngtgttnttctctgcctnaaagacngatacacatggatntatgtcgnngnnantncatgtactgncggccagnnttgtaatttgngacaaggangntgctnttncaaacctgancntgcnattctncacgcaccatgcaatgcgacancanatgaattgacctganccctacnantgcanaaggngtnanttctgtctgnaaacgganntgatggantnttnnaagaatgcgncngtaanannnnatnctntgncnganctggacgtgcncttctgcttggataccaactttaacnagacctcgccnatatgtcatnaantgagaacccgcttgccangacatatcnntnttttctctgaaaacagaacatttatngtnnaanngctatncctcaggtntaaancccatcgang

SEQ ID NO: 1407 - DNA, 550 bp, Ctenocephalides felis
gtcaacagcgaacagcgagtctcggccgcggnnctctacaatcattaatgatacgcacgcacgccacgtaactgggcgcagatatcgcaaaaatacataacaggagtaatagtatagtaatagtatattcatttgaatagacttgagattgagacaaatagcgcgcgatctgcaagtcattgtgaccaacctttgacgtttagcgaattcatcgtgtatgtgttttggaatcctattattgtgtgtgtttgtgaatttcgtgttttattaccgtgtgaagttgtattcaggtgctctaacactaagtgattttcaacaaagattttttaagaaataaattttaatcaaaatcgaatctgctacaataatccggctgaaccagtagatgaccttgacaacgagtttgattcgtagcgattaacgaacgctgccggaccttccgaccaatactcacggatttattttgattaaatgagattctgttataaggtgacgtctagaaatagatgcagatgtgtaaccttgtttgcgnggcagagaaactgtgtcg

SEQ ID NO: 1408 - DNA, 428 bp, Ctenocephalides felis
aaaaaactattttatactgttacgtaaaacatgtttcaaagtacagttatagtttgcagtgcatggtaaactactttggttcttatttaatcggatgtttaattaacagatatccaaagatgtaacttcaactttccaatctagtacaaagaatttttttgaacaaatttatggaatgttcggatttcgattcccaaccaccaccggatgggattttgcaaatcccaccaccaccgccaccgccagaaccaaaattttatgaattgtgcgaaaaattggaagaagatcgccgaatatcgatgtatgctcttgaaagcaccccaggcttcaccatgtacacagaccactggtatataatattgattgtgattttagtagtaattgtatcgataataattataatattcctcaaaaaaaaaaaaaaaaaa

SEQ ID NO: 1409 - DNA, 455 bp, Ctenocephalides felis
tgaacgtccagaaccaaatgatgaagatttctgaaaatctgcgcgcgtaaaacaaataactaaggttagacatggaaattgtgaagtatgtcacaggcacgccgcacgggacacctcacattcagccattcagggatcatacaagtggcgaccgtgcgaagcgcgagccctgcgtgaacgcgcgaaccttccgccataatataggtttcagtttaaatttatagtatcatttcaaatttaacttttagaacagaacaatgttcaaatactatatctgagtattatctgaccaatactgctagatctattacacttatgcagtcatcaattagtacataaaagaaaacaatataagaaaaaaatattattttcttgcattattcaaaagaagctatgtaaatattaataaagcataaatagaaagattcacataattcaaaaaaaaaaaaaaaaaa

SEQ ID NO: 1410 - DNA, 550 bp, Ctenocephalides felis
gaagcatttcatctgtcgatcataatctagtcnaggtggaaaaatgaaaatcgttctcttaacaattggctttttggtcgcggtcgtgtcttcaaacacgatctcattggatgaaagttttgagtcaagttttaatgatttaaaatcactcgagagcagaggggcattagaaaataaactattagcagctgctgaagatctgagaaaaactttaagaaaaggtggtaatttgactaatggcgaagttatggacccatggttccttgaaaatgttgatgctgacattgaactaccaaacattgccaagctaaacggagctcttgccaacgtaacagttgatggtttatctagtttcaatataaatcacataaaagtgaatgtgctcttcatgaaagctactttcaatatcacttttgaccatctcatggcaaagggtctatacgacattgaaggcaagttggcagatttggctaagttgttggcaaaggttcctttgatatcatgnacgtgattaaacgctgtggacatgtcaactatggttgaaaggtta

SEQ ID NO: 1411 - DNA, 550 bp, Ctenocephalides felis
gtcggtcaattctacttaatcgctgtgcaattatattgtaacttgtaaataatcgttatgctatagctcagtgtcgtagagttattttgatatgaataagtcataagttctatcaagatataaaattattgcctaatatcaatgatcaccaaacaaatagtttttaattcgttttttatttaattttaagagaatattattatgaatatgttaagattatataaatagttatgaacgtttttcttaagaaatactcaaagacataatatatacaaacttcatataaatctgttcttaatataaaacttgttaagagattttgtcatatctataaattttatttacttcgaaatactattaaattgtgcataaaattatttgatatacagtgttctttttaatatccacttttattattttaaattcatatagtattttcatattttatgttaataaaatatatttaatcagacactaactcttatttataataatatgtacatttggtctcatgatagaaatactgtgatgctaaaaaaaatggtgtcgg

SEQ ID NO: 1412 - DNA, 550 bp, Ctenocephalides felis
cgccaacgtctatttaaaattttgatatgcaatttgtgttaaatgcgttgtaaagaaaactatttatacctatttactgttgtctttattttgcttcatattttatttttcggtatccataaatatcgttgtttgtgaaaatttgtgtgaaaaagtctattaagcatcttcaagtttggtatggctaaacctcacctgaagaaagtagcgttcctgaggacccgctatgtcacagcactaaaattaagatttttcttctttgtgacaataccagtttgttatttggtatttacagcgttaacaaaacaatccgtttcttctgaagatattgaatattacccgcagacaccagaaattactggatcgcggaaattgcttggctatctttcaccgatgccaagaattcgagcctggcagatgatcatggtcataactgcacgcccgcagctatcttagattttccctctgatggattcaccagggagcaaagaagacagggctgggcctggtccatgccgcatcgatctactgttctggctttagcatagtt

SEQ ID NO: 1413 - DNA, 550 bp, Ctenocephalides felis
ggaagttaccagtatggcactcctacattatatccacaaatggctacaacagcaaatgcacatggttcaacaactaatagtggataccccaagccttcttattctggttataatgcaggttatgaatcactaagccaaagccaagattatacaaaacccagtggttcttatggtccaggaggaagtgttagcggtactacagtggtgcctcaggtatctggcaaatccaacacaactacatcggggagtgttggtccaaacagtcagggtgctaatgtgcagacaggtgcaaataacacagatatagcaagcgctatgtataataaaactcatacagcattaaataaagttaattcttatgagaagcaaacatttcattcgggcacaccaccaccgttcaacatgccaggaagtggttccagtggtactacttatggggctccgcatttatttataccaacaatggcacctcaccaacaagctcatcataatacacagatgctgatcagcctttgatagattatgggggccttcacaagtagtcacangg

SEQ ID NO: 1414 - DNA, 550 bp, Ctenocephalides felis
gttattcttaaaaagctaagtagaaataatttatctttatcagttcaattgatttacatgtgaacatgattaacatattatcttttatcaattttaatgttcaatgtgatgtttagtgtaaattttaagttatttttttaattatgatcatatctttttattcctacatgtctttcattttagtattgcatataatttttagtaaaaaccccttttcagttacattaatgttttctgttgcatgctactagagaaagtagttcattctaatttaatgaatgttagtaattgaatgcttgtttagtgttagtttttgagattgaccaaaataacatcttttctatctgatcatattctgtgtatttttatataatttatactaacagcttgcttttaataaccgtttgaatttagtttgttattgttgtgatcaaaacgataatttgcatgtcttcaaaatttctttgccagaaatttggaaaaaagtnttcttatttatgaccaatttatgntgagtctaattgggtttaataatatttaattctggaca

SEQ ID NO: 1415 - DNA, 550 bp, Ctenocephalides felis
cagagatgaatacaaatttttaactcaatatggtgtaatcataattttctaaagttaatcgaattcgaacgaagtgataagtaacattgtgccaaaatgtcaatcttagccattgattttagtggtctggggcctcgaaaatctgtttttgttgtcattataatagtaggatgtttttctattttatggccaaaaatatttcatcccatgtttatgggatttccagatcaacaaattatgccaaatgctatggacagatacgcaggttgctgcgatgtgatattcagcagcgatatgaacgctctgatgacagtaactaatttatgtgcccaagtgcttaaatttcaagatttcaatgaaacaaagttattgggctcaaacgtgaataatagatgtagggccgaaatattatcacgctgcggcctggcatattaccggtattttcatccggaaaaggtggtccagatgttaaaggagtgaaacgccttcttacgagatngttcgcttaatggctcatcttgcctnagtgagttcggaatcctccatggct

SEQ ID NO: 1416 - DNA, 549 bp, Ctenocephalides felis
attaaaaaaaaatctcaaatcgatcataaaagttttaatattaatttcagtaattaatacaacttctggatcagatgctaacaaatacgaagccacctgggagagtttggatagcagaccatctcccagttggtatgatgatgccaaagttggaatatttttacattggggagtttatgcagtaccaagttttggcacagaatggttttggcaaaattggcaaggatctaatgtgtcctcctacgtggattttatgaatcagaactatcgaccgggatttacatatcaagattttggtacagaatttactacggaactgtttgatccaaaccactgggctgagctattccaagcttctggggctaaatatgttgtgttaacaagcaaacatcacgaaggatacaccctgtggcatcaaagtactctttcagttggaactcccaggacgttggtgctcataaggatttaataggtttactaccaacgcaattcgcagcaaaaccaactacgtttcgtctctatcactcttgtcgatggtcacagacttat

SEQ ID NO: 1417 - DNA, 549 bp, Ctenocephalides felis
gtgtattcatattaaaaactgctgaatccacgtgtgtataatgtcagacgcagtggtggcaggaagtggcggacaacctaattctggacaaatcaagaaagaattatcggaaggcattatataccagaccgcagaaagtccaggatcaacatgctgcacagcgctgtattccgatgtagaagtgataaagatggaaatttcggatcattttgaagttgttgacccgaaatctctacagatagcaaatagtccgggtagtccagatagacaattctgcagctcaaccacggcgtcaattggggaaattacgacaaacgatgatattaaagaagacagtccaaggcgtctttgccttgtttgtggtgatatagcctctggattccattacggcgttgcctcatgtgaggcatgcaaagcattttttaagagaacaatacagggtaacatagagtataattgtccggcagttggagattgtgaaatcaataaacgaaggcaaaagcatgtcaagcctgtcgattcaaaaatgttagcattggatgtaaaaga

SEQ ID NO: 1418 - DNA, 549 bp, Ctenocephalides felis
gccgtcaaaaatggctggagtattatttcgtgttaatttggctaaaacacaattgggcataatcagcccagtttttacaattagacataacagcggtggaccaccaccaccaggcactccacctccacaaacacgtactaaatttggtcctcttaaagatgaagacagaatttttacaaatctttatggacgtcacgattggagattgaaaggatctttgaaaagaggagattggtataaaactaaagaaatcattcttaagggagctgattggatcataaatgaaattaaaacttctggactcagaggtcgtggaggtgctggttttccttcaggtttgaaatggtctttcatgaacaaaccaggagatggaaggccaaaataccttgtggttaatgctgatgaaggagagccaggaacatgtaaagatcgtgaaataatgcgacatgaccctcataaattggtggaggctgttaattgcaggaagagcatggcgctcgactgctcattacatagaggagaatttatatgaacatcaatntcagttgc

SEQ ID NO: 1419 - DNA, 406 bp, Ctenocephalides felis
gttaatttaaaataacaaaatgaaaggaacattattaatattatcatgtcttgtgatcatgataagtgccgaatatgctgacgtagatgtgtgccaagatttggacgatggaacttttcttgctgattcaaacaattgccaaaatttcttcatttgtgatggaggccgagcttggaaaatgtattgtccaggatcacttttatggaatgatcacgaaggaacatgtgattacgcacaaaatgtagaatgttaccaaccagaataaaacattttaatatctgacagcgattttctgaaactatatttcatactactgttataataaatttatcttcattgctctcctcctataaatttattccgttttaataaaatcaatataaagacaaaaaaaaaaaaaaaaaaa

SEQ ID NO: 1420 - DNA, 549 bp, Ctenocephalides felis
agaacagaagtatatatgatgagtatcagtgcaatttaataatgagagaacgttgtttcaattttattagtaccatataccatataatgaattagtagaaaaaaaattgttgtagtgttttagtattttcggacatcaactcattaaattcataatgtcttcaggtagacctataaaatgtgttgtcgtcggcgacggaacagtgggaaagacatgcatgttaatatcatacacaactgatagtttcccaggagaatatgtccctacagtttttgacaattattcagcacctatggttgttgatggaatccctgtttcattggggctttgggatacagctggacaagaagattatgatcgattaaggccgctgtcttatccccaaactgatgtatttctcatatgttttagtgttgcaagtccgtcatcttttgaaaatgtcacttaaagtggtatcctgaaataaaacatcactgcctgatgcacctataatcttgtggaccaaaatagattaagagacgatagagaaaccttaagttctctacagac

SEQ ID NO: 1421 - DNA, 549 bp, Ctenocephalides felis
ctgataccatcgaagccagtgctgattcatgacttgggtcgtgtttatatacaaactggtcctgatgttaagaggtgcattcttagattattagagggaccagttagacaactcggcatggaaaatactgaattgatgaaattagttgaggcctgtgcaaagggatctgaaaccttggttacaagggtgatacatattttgaccgaaagaagtttgcctagcatggaactagtttctagagttcgagatctttatcacactaaagtatctgatgtccgattcttaataccagtattaaatggtcttaataaagacgaggttatagattctttgcccaaattcattaaactaaatccagtagttttaaaggaagtttttaataagctgctgaataatcaagcaggtcctacatcatatcctagtccagttacacctatagagttgttgtagcgtacatacaatagacacaactagtgcagatttaaaattcgagtgaaagcaacaagttgtgttagcagagaagnaattacacccagaangatgcagagt

SEQ ID NO: 1422 - DNA, 534 bp, Ctenocephalides felis
tgangatcggcttgtgcgcgtacagtggatacaaaatttatcccggccatggcaaaaccatggtcaaaattgatggaaagacattcactttcctcaattcaaaatgtgaggctgctcatttaatgaagaggaacccacgtaaagtaacatggactgtcttgtacagacgcaagcacaagaaaggtcaagaagaagagttgactaagaaacgtactcgtcgtacacagaaattccaacgtgctatcgtaggagcttctcttaatgacatccttgccaagaggaacatgaaacccgaagtacgaaaggcacaaagagaccaagctatcagggctgcaaaagagcagaagaaatccacgaaagcagcaaagaaggctgcagctccacctaaagtgaaagccccaccaaaagctaaggccgctaaagtgagccagaaagcacccccagggttggcggtaaacgataagtggtgttggagattattctaatgtattatatgaaaaataatttgtaaaatgctaaaaaaaaaaaaaaaaa

SEQ ID NO: 1423 - DNA, 549 bp, Ctenocephalides felis
tgaaaaactacgatccccagaaggacaagcgtttcagcggcaccgtaaaattgaagcacattccacgaccaaaaatgcaagtatgtattttgggagatcaacagcattgtgatgaagctaaggccaacaatgtcccatggatggatgccgaagctctgaaaaaacttaacaagaacaaaaagcttgtgaagaaactagctaaaaaatatgatgctttcttagcttctgaatctttaatcaagcagatcccccgtttgttgggtccaggtttgaacaaggcaggtaaattccctggtctcttgtctcatcaggaatccatggtgcagaagattgatgaagttaaaggaactatcaaattccagatgaagaaggtgttgtgtttatctgtagctgtggtcatgttgatatgtctcctgacgagttggccaaaacgttcacttgtcaattaacttcttggtgtcacttttgaagaagcattgcagaatgttaggtctctcatgtcaaatccactatgggcccccaaagatatataatacataatgatatgtt

SEQ ID NO: 1424 - DNA, 549 bp, Ctenocephalides felis
aaaattcacattttaatcacaattaatgtctagtttctaaaccacaaggaatatacttataaatatatttatataaatataaggaactgaataatctttgatatttggttgtttgggtatttatgttgtacaattaatatatcctttaccctaaagtctacatatattatcaaccatgggtaaagcagaagtaggtacccccaagtacatagccaacaaaatgaaggccaaaggcctccagaagctccgatggtactgccaaatgtgtcagaaacaatgcagagatgaaaacggtttcaaatgccacacaatgtccgaatcccatcaaagacaacttttaatctttgctgataactcacacatgtacctagatcaattttcaaaagaattctctgcggcttcttagaacttctgagaagacaatttggaactaaacgagtggtgctaataaagtgatcaggattatatatctgataggaatcatttgcacatgaatgctcaaagtggtgcattgcggggttgcaagtggttggggaggaaggcatgcgt

SEQ ID NO: 1425 - DNA, 549 bp, Ctenocephalides felis
gcaagttagggatcttgatattaacactacagaaagacttaaaggtgttatggatttagtatttgaaaaggctgttgatgaacctagtttttctgtagcttatgcatatatgtgtaaagagttagctcttatccaagttcctgctgaccaacaaaacggtcaatcttcaactgttgaatacgtcaatttccgtaaattgctcttatcccgttgtcaaaatgaatttgagaaaaatacagtagatgaaaccgcaagagaagttaaactgaaagaaattgaagcgtgtacagaccctgagaagaagaaggaactacagtttaatttagaagaagaagagcgaaagattcgtgttaaatctgttggaaatgttagatttattggagagttattcaaacaaggtatgttgccacaaaaattatgatgcagtgccttaggatgctctgcagtcaattgaagaagaaagcctcgagtnctggcaaattgtgcgacattgccggatttagaaattacaaaatcaagatttnaacctctttcttaaaatgcaagaat

SEQ ID NO: 1426 - DNA, 549 bp, Ctenocephalides felis
cgccgtcagcagcacccaggccgaatctttctgtatctctctgggtgtcgggcctctgtggtggtcctgatgatttccaccacgagataggacatagcccaccaccttaccatgaagacgacgaccagctgcggcacacccgcaaaagcagcataagtgatagcgattcagaagacgattctattgatacttcgccggattattcccagaacgcggatgtcgatgagttacttcaccttggcaaaccagtacgcattacattcgaactacggctcacgaagcgcaacagcacgctatgggagacagttttgaaggagaacgtgctctatgtaaatattcctaatgtattgccttctgaggggtctcgtgaaagtttcacggcgctcctggaactgaccgaggagaagttgggatgccattcgatggtgttgtgcatgcgacgcgatcgttcagacagacagcagctcatgcggcattcatgttcctcgggttccaactgtgcaccaaacaacaagctaatgcaccgaaggtcacgatgatatttgatct

SEQ ID NO: 1427 - DNA, 549 bp, Ctenocephalides felis
atttgtatttatgatttagatttatagtgcattaagatttgtgcttcaaaaatgttatcacgtgcctcatatacttcatctgtattcttaaattcgctgcagcaatttcgtttacaaagcacattagtaattgctgaacattcaaatgcaaaattaaacccattgactcaaaatgctttaacagctgcatcaaaaattggaggtgaagtaacagttttaattgctggcaaaaattgcaaaccgcttgctaatgaagttgccaaagcagcgggtttgaaacaagtcttattagcggaaaatgctgcatttgaaaactgttctgctgaagccttgacaaaacttgttgttgcagttcaagagcaatataaatttacgcatattattggtggtgcaagttcccttggcaaggctgtattgcaagaatagcggcaagttagatgtttccctatttctgaaataattgatgttaaagatctgaacattcgtcgacaatttatgccggnacgctttcagacactgaggtgaaagatccctaaagctatcttcgtg

SEQ ID NO: 1428 - DNA, 555 bp, Ctenocephalides felis
rchsncggaaatatgagcatttacgtcagttttgtatggaattgaatggtttagcagtgcgcctacaaggacaatgctttcctgaacaatgtacacaaatgactgcaactgaacaatggatatttctatgtgctgcccacaaaactccaaaagaatgcccagcgatagattatacaaggcacactttagatggtgcagcttgtttattaaacagtaataaatattttcccagtcgtgtgagtataaaagagtcatcagttgctaaactaggttcagtgtgcagaagagtgtatagaatattttcacatgcttattttcaccatcgcagaatttttgatgaatttgaagctgaaacatatctatgtcatagatttacacagtttgtaacaaagtacaacttaatgtcaaaagacaatctgattgtgcccattttagaggaggatgcaactatcggagaatcagaggcttaagcatttatgttatttatttaaaatatctgtgcatgcattttttatttttcttgtgagtgancgtttattaaatcattatgtnnat

SEQ ID NO: 1429 - DNA, 549 bp, Ctenocephalides felis
gtcaactgggtcactagagtagatctacgagacaagaaaatcgaatatattaatggcctaggatactttaaagatcaaaatactattatagctgtattaaagaataaaagtgaaaaaatattgtctgccaaaaatattgttatcgcagttggaggacggcctaactatccagatattcctggagcactagagtatggaattactagtgatgatattttcagtttagatagagaacctggaaaaactgtagttgttggtgctggttacattggacttgaatgtgcaggttttctgaaaggattaggatatgatgcaacagttatggtccgctcagtcttattgcgtggatttgatcaacaaatggctaatatcattaaggaatctatgattgaaaaaggagtcaaatttttagatacatgcattccaaaatcagtagaaaaatgctcagatggcaaacttcttgtacttggtaaatcttctgataatcccacattcagatgtatttgatccatttgttgtatcggaaggaagcttaacaaagattaaaat

SEQ ID NO: 1430 - DNA, 549 bp, Ctenocephalides felis
attgccttaacgctggcattttaaaatccgtctatttgggatcaaactcattagatggcgatggtacatactacgacgtcgaacgttttgtgatgcatgataaatatacaccaagaatcactgtcaactatgctgatattggtctaataaaagtggcaaaagacattgtattcggtgacaaagtccaaccgatcaaaattagcaagagaaacatcaagggtggtgaaatttgcaaggcaactggttggggtctattaggttctgtggactcagtaccaaacgaattacaacaagtagaaaccactgcaataacaaacgaaaagtgctttgaattgactcaattcattgacccaacttcgcaaatatgtacattcagggaatttggtagaggcatttgctttggtgattctggtggaccactagtttacaaaaatgaacttgtggcattacatcgatgcacttatctcctgcagaggtggcaggcagatattttgtgaagtgcgagatttccaatcctggattaattctgaaattgaaaaaataaataga

SEQ ID NO: 1431 - DNA, 549 bp, Ctenocephalides felis
gcccagtgcacgaggagcatgaggaaccagatccaagaagaactgagcgcttcgatgcaatacttggccatgggggcgcatttctcaagagacactgtcaacaggccaggatttgctgagatgttcttcaaatcggcaagcgaagagagggaacatgccatgaaactcatgtcttacttgatgatgagaggagaactgaccgagaggctgcaggacttgatcagaacaccaactgttccaatcacgacttgggctgatggtttgagtgctttgaaagatgctctgaaattggaggcttccgttaccaagaagattaaacatgtgatcaaagcttgcgagaacgataatggagctaatgattatcatttggttgactacctgaccggtgaattcttagaagagcaatactctggtcaacgtgacctgccggaaagatctccaccctgggcaagatgatgaaccaacaaggtgttctcgggagttcttgttgacaagaaactctgggttaaatgaaacatacatcccatcaaatatcacagtaataaaata

SEQ ID NO: 1432 - DNA, 549 bp, Ctenocephalides felis
gcaattttcagtgataaaagtgaattttaatttgtaaattaaaatgtcgctgtgcaaccgagctgctcaacgcgagcacgtattagccgtaactcgggattttatttctcagccccgattaacatacaaaactgtctctggtgtcaatggacctctggttattttggatgaagttaaattccccaaatttgcagaaattgtacaactcagactttctgatggaactttacgttcaggacaggttttggaagtcagcggctccaaagctgttgtacaagtttttgagggtacctcaggaattgacgctaagaacacactttgtgaatttactggtgacattttgaggactccagtatcagaggatatgttaggtcgtgtgttcaacggatcaggaaagccaattgacaaaggacccccaattttggctgaagatttcttggcatccaaggtcaacccatcaatccctggtctcgtatctatcctgaggaaatgatccaaactggatctctgtattgatgtgatgaactcattgtcgtggacagaaatccc

SEQ ID NO: 1433 - DNA, 549 bp, Ctenocephalides felis
gaaaaacaaaattatttgatacattttaatctagaatcatctgtgtggctaaatattatttgtgtttcaatttcgactatttgacgaaaatagataatagaaatggcacctaaagcatttggtgatgtgaaaatgcaaggacaagcatataaagataaaagtaaaccggctgatattcgtagcagcaatatatgtgctgcgaaagctgtttctgatgcagtacgtacaagtttgggacccaggggtatggataagatgatccaagcctcaaacggtgaagtgacaattaccaatgatggtgccacaattttgaaagaaatgaatgttactcatccagcagctaagatgttggttgaattgtctcgggcgcaagatattgaagctggcgatggcacaacatcagttgtagtagttgcaggtgctttgctggaggctgctgaaaagttacttcacagaggacttcatccaactgcatttctgatgcatttcaaagatgtgctccaaagctgtggaaattcttacacctgtcacaccaattgacttactgtc

SEQ ID NO: 1434 - DNA, 549 bp, Ctenocephalides felis
tgtgtattattcgcacacgtgaaataaatcatatcggtaaacttgtaatatctattttattaactaataagcgtagtttgtgtaataacaagtaatttctattagtagtcataagtaattgaagagaaaactattttccatataagaattgaaagcataaaatgattctctccgtgctgaaaaaatctcgcatcgtgcacttgtgttttgccatttcattcttcacatcaggcctgatcataaacattgcacaattcatattatacacatgtctcaagcctttcaacaagaggctttacagaaaacttggttattatttgtgctacacattttacagtcagatagtgtttttagctgactggtggtccaaatctaatctgaccttacacatatcaaagaaagattatgaacaatgtgggaaggaacatggtcttttaattatgaatcatacgtacgaaacagattggtattaggatggatgtttacggaaaaaattggtgtcttggaattgtaggatatgcaaaaagactattcaatacatccgcatta

SEQ ID NO: 1435 - DNA, 509 bp, Ctenocephalides felis
ttaatattagaagcaatgactgagagcaaacccatgttggtagagcattgcccattacttgtggaaggtgcacctattcctccagagcctgcaattggtcactggagacctgaggctacattttatcaagatggcgcaagaattgaagctggttttagaaaatattttcaccgagcagatcctgatcagaaggaagacagttacacaatgattgtatgtcacgccaatgtaattcgttattttgtgtgcagggctctgcaatttcctgctgaagcttggctgagactttcattaaatcatgcatctattacttggattagtatacagcccagtggtagagtaattctacgagtttttggggaatcaggtcatataccagcaatacaagttaccagtcagtaaaattttaataacataagataatttcaatttatttttattcgttttcttgaaatttatatattttgtatcaaattatgtttatatacctgcaaaaaaaaaaaaaaaaa

SEQ ID NO: 1436 - DNA, 549 bp, Ctenocephalides felis
aaaaaatattattctaacattatggcgcagatacctgcacgaccgaaaattttgttaactcatccggatataccgaaggaagctattgacatcatgtctcccaattgcgaaataattatgtgcaccggacgtccgtctccatcacgacaaggaattttggaaaaaattgtgggagttcatggtttaatgtggtgtactaaagaacgtttggacaaagagatattagatgctgcaggacccaacattatggccatatctactatgtcggctgggctggacaatgtagatttacctgaaatccgcaaaagaaatattccaattggttatactgcaggagttctgaataatgctgttgctgatttaactgttgggcttatgatagctactgctagaagatttggagaagctaggaaacacatagagaatggaacatggggaagcggacctgcgtggtttttaggcagaaatgtatctgaaactcagctggtattgtcggctaggagaaattggcaaactgtgcaagaagatngaaagcttcaatatgactat

SEQ ID NO: 1437 - DNA, 251 bp, Ctenocephalides felis
gaatttggtagaggcatttgctttggtgattctggtggaccactagtttacaaaaatgaacttgttggcattacatcgatgcacttatactcctgcagaggtggcaggccagatatttttgtgaaagtgcgagatttccaatcctggattaattctgaaattgaaaaaaattaaatagattccaatcatgatttgttataatgaaaaatggtttaataaaggcagcataatttaaaaaaaaaaaaaaaaaa

SEQ ID NO: 1438 - DNA, 549 bp, Ctenocephalides felis
gttttattgaagaaactaaaaatgcatttttattttaaaactggccctggtgttcatgttatatgcatacagaagagaagtaatttggggaatacacaaaaatggaagatgatgccgatataagagaacaaatttttcacaacaatgtcagagagcagattatatttctattactctttcttctgctgtatttctcttcgtactggctgattggatggtttcgtcgcaaagagcgcgatgatttttacacttgcgcctacgacgacgatggcgaggcgacggtgtacagaatcagcctatggctctgcaccttcgcgcttgcagtcagcgtgggagcagcacttttactacctatgtctattgcaagtaacgaagtgctgatactgtatccgaacagctattatgtcaagtggctgaacagctcactgattcaaggattgtggaaccatgtattcttgtttcaaatttatcactattcgacttctgcatttgcatacctgttgcggagtcttccggattcgaaggacgcgaaaggagtttggcagactt

SEQ ID NO: 1439 - DNA, 549 bp, Ctenocephalides felis
gtcaggcgcactttacttaactgaaggtggagaacatcatgctgttgcttccatcaaatatcacgaaaagtacagcccaaacactttggataatgatgtggcagttttgaagttgaaaaatccattgactttcaatgctaaccagaaacctgtcgccttggcctcaaaggatacacctggagacctcaaatgcaaattctctggttggggattagacgcatatccaagtgatgttttaccaaatcatttacaaaaaatggacgttctgacctacaataatgctgattgccaaaagttccataatgctggacctaaatctaacacaatctacccaggaatgttatgcggattcaacaaacttaatgttggtgcttgcaggggtgattctggtggccattggtatacgaaagtgcaaatggtttggaacaagtcggtgtagtttcctgggtttatgaatattgtgctgtgggtgtgccagatgtctacgttcgcgtatattactattggactggattcacgaaaatccgcctgttttgcataaatatataa

SEQ ID NO: 1440 - DNA, 549 bp, Ctenocephalides felis
gaattggctagtgaatagtgtttgtgtttattaataaaaaatatatgatttatttactatttacttcaaaatattaaaatgtttcccagttcaaggtctatagtagtgttaagtaacaaggcatctcgggaatttttgaaacaaaaacttatacaaaatgttatcgtgaacaagtactctacaaatatagctgaggctgtatccgtcaaagatgctttaccatacaacaagatacctggaccttcaacattaccaattattggtgtagcccatcattttgcacctggaggtaaatacaaaggtctcgatttagcccaactaacagaaaagctctatgaagaatatggagatattgttgccatcagaggattgcctggtaaacccgatatggtttcctttataacttcgatcatatggaaaaagtatatcgtctgaaggccttgcctgatagaccagcttttgaatcacgagaatattcttgagagaaaaaagaccagaagtttcaaattgttatggctaatcactccaagggaagaatggcaaaaatcg

SEQ ID NO: 1441 - DNA, 549 bp, Ctenocephalides felis
attttgaccacatacacaatggttagcagtagtcctgaggagcggaaaatgtttcgtgttacacaaatgcattatgttatatttgatgaagcacacatgttgaaaaacatgaatacacagagatatgacaatttgattaaaataaaagcttcaagacgaatattgctaactgggacacctttgcagaataatttgttagagttaatgtcacttttatgttttgttatgccttctttatttgattgccaaagggaggatttgaaaagtttattccagaaaaattcaaaaactaactcaacagtgaagaaaggtgaagatgatgatgatttaccactttttgaacaaacacaaataacacaagctaaaaagattatgaagccgtttgttctgagaagactaaaaagagatgttcttaaagatttgcctaaaaaaactgattacactgacaagttccaatgcaccttctcaaaaacttcaatatgagcaattaattcaaaccttttttcagaaccggagaaatcatgcaaataaagaaagagtggaatgcaa

SEQ ID NO: 1442 - DNA, 549 bp, Ctenocephalides felis
gtggtgcaggatttgtagatggtatgaatcttggagataacaccaaggcagcagttattcgtcttggtttaatggaaatgattcgttttgttgatgttttctatccaggaagtaaactttctactttctttgaatcttgcggtgtggctgatttagttactacatgttatggtggtagaaatcgtagagtttctgaagcatttgtgaaaacaggtaaatcattgaaacaattagaagacgaaatgttaaatggtcaaaaattgcaaggaccaataacagcagaagaagttaattttatgctgagaaatcgtggcatgcaagacaaatttcctttgttcactgctgttcataaaatttgcacaggagatatggatgttaaagaatttcttaattgtataaggagccacccggaacacatgtaagtgcctgctttataaaatataaatcagatttaaaatgcttctcagatggtaatattagtaatgtctttacatgaacataagtgagagttgctagttgtttgatattttgntcttcatatagtatttg

SEQ ID NO: 1443 - DNA, 546 bp, Ctenocephalides felis
attttgttttacattaaatttttcaaattcgatatgaaatttttactggcaatttgcgtgttgtgtgttttattaaatcaagtatctatgtcaaaaatggtcactgaaaagtgtaaatcgggaggaaataatccaagtacaaaagaggtgtcaataccatctgggaagcttactattgaagatttttgtattggaaatcatcaaagttgcaaaatattttgcaaaagtcaatgtggatttggaggtggtgcttgtggaaacggtggttcaacacgaccaaatcaaaaacactgttattgcgaataaccatattccggatgaaagaccaaattgatataaattactaaaattatgctagatagcaatcataaaattttgaagttttcaatgatcctaacatgttttgcctcaatttattttaacagcaaattgtggaactaccgtccgtacaaatgtcaagaaatctgatgttacaatagatattataatatgtacattgctatattatagaatatatactgattgcaagttgaaaaaaaaaaaaaa

SEQ ID NO: 1444 - DNA, 550 bp, Ctenocephalides felis
gcatnatgctgaagtgtggatttatcgttgttttncttgtagcctccgccttgggcgagttttcgctcgacgaccgcatcgtaggcggcaccagtgttaatatcgagaacttcggatggcaagtgtccttgttcgatcgtatgggacacttctgcggtggttccatcattagcgacgaatgggtcttgacagcagcacattgcgtatttgacctattctcgccaaagcaatatgcagtgcgtgtcggaagtagtttacataacaaaggtggattnatccacaaaattgccaaagtatatatccatccagactacgatgaagtaagctacgacaatgacgtcgcagtcctgaaagttgaaaagagatttagactgaacggcatgagcgttcgcacagttaaattggttgacgaagatcacgagttgatgatggtgcccacttactgtcactggatggggcaaattaatgaataggcccacccataaattacangagtgaaagtgcctttgtcgaccatgatcatntccgcagtactctttccggaaacaat

SEQ ID NO: 1445 - DNA, 550 bp, Ctenocephalides felis
gttatcaacaggattttggagatcgtgcaaggtgtttccaacctagtctaacttcttcatcttcaatatgtgatgaacgattcacttggaaccctgataatgagcaaagaatgattttacaagaagctctgtccaaagcacacactcatttaggcactggagcatcaataggttccggttccatttctggtagctccattggttcttcttctacgtcgtcttcctcatctagttcttcctcaagttcttcttcatggtctggcagcggaatgggagttagttcaactcaaggacaaaaggaaattgttcaaatcagcccacaaaaagtagggcttaaattaagaattaatgaagttcataaactaaatgtttattatgcacaagctgagattatccagtagattatattatttgatggacttgctaagtctatggaagatgataagagagatgncagcattggagattactctcagaacctgagaaatatactcaaattccggtgggtttggactttgnggataagtgngatgcntatgtgcaacatgcc

SEQ ID NO: 1446 - DNA, 550 bp, Ctenocephalides felis
cttgtgccggtccgagagcaccctaaattcaactttgttggaaaactgttgggacctaagggtaattccatgaaaagattacaagaagatactatgtgtaagatggccgtcttaggtagaggctcaatgaaagacagacaaaaggaagaagaacttcgtaattccttagatcccaaatatgctcatttggctgatgatctacatgttgaaatatcggctttgggtcctccacagaagctcacgctcgagttgcttatgctttggctgaagtccgtaatatttggtccctgataataatgatacaattcgccaagaacaatgcgtgaaatgatgactgacccaatgcccgccagaagaaatgagangagcacccacattagacgaggtggttggctgtggtgcttctcgngaggaggatactaatcgngcagcttcgacatntggggnatgcttctgngttctaatgtgatccggcctcacccctcctcactcgtgtatcctgtaactaaatcttcattaataacaaagtgctgagaacttgtntaaaccc

SEQ ID NO: 1447 - DNA, 550 bp, Ctenocephalides felis
tcttattcatattaattataagaacatttattngtatttcttcaaattcttgattaggagcatgaattggattagaaataaatttattatcatttatccctatactaaatgataataaaaatttactatctaatgaatcttcattaaaatattttctagttcaagtttttgcttcaattttattattattttttatttctttgaattttttatttaaaaacttttttagaataatatattttaatgaaatttatttaattttattaaattcatccctatttttaaaaataggggctgccccatttcacttttgatttcctagaataatagaaggaataaattgaataaataattttattttaataacatgacaaaaaattaaccctataatttgttaagttattgnattaatataaattattttatttaattcattattaagaattataattggagcttaggtggattaaataatcctcttacaaaaattatacttattctcaatacactatggctgaataatattgtttaataaataatgaataatttt

SEQ ID NO: 1448 - DNA, 550 bp, Ctenocephalides felis
attttttaaagttttttttttttgaaattaatgtatttgcacagtgctcaaatatataatattgcttctaacatataaaaaatgagtttgaaaagacagcgcgatgataatcttaatgaagaacctgataagaagcttatcaaccgttcatgtccatacttagatactatcaatcgtcacgttttagactttgattttgaaaaattgtgctcagtctcgctaactagaattaatgtttatgcatgtttagtttgtggaaaatattttcaaggcagaggaaacaacactcatgcttacacccattctgtcagcgaatctcatcacgtctaccttaatctgacaacattgaaattttattgtttgccagacaattatgagataattgactcttccttagatgatataaaattgtattaaatccagtgtttcacctgaaagcatagctgcattagatgtaatgtgaagctatctagagctatgatggtctatgatatgcccggaatggtggtcttataatattaagcaatgctatgcatgtatctgcagcctt

SEQ ID NO: 1449 - DNA, 550 bp, Ctenocephalides felis
gtcagatcaagaatgtgccagtcttcccaattcaagatgcgatagtggcatttgtgtttgcaaattcaactttgtgcctcatccagaagacccaatatgtctagaacgtaaacaattgggtgaacactgcaacgtaggcgaacaatgtcacacaaaattcaacttcaatgctcattgtgtccgagaagtctgtgtgtgcagggaagatcaccacgaatcgaggaacagaacttgcatccaatctaaaggctataaccagaattgcgttgatgatatcgaatgtttcatcggagaagaatacagagacaggatcagatgtttccagaacaagtgtctttgcaaacctgaatttccagtcactgaggacggaaaatgcggatccggagctccaggcacacaagtgtggtcctcggttatgacattagcagttatggcatcagtagcaaaaatcatccgatgtaaaagtttaaaaatagaatgtccaagaaaataagaaaagacttaccaaaacttacttcgattacttaagaacatcttttcnagcatagng

SEQ ID NO: 1450 - DNA, 550 bp, Ctenocephalides felis
gtgnaacttcatgtactataatattatatttgtattatatgtattataaattcatacatgcacacacacacatatgtatatatatatatatatatatatatatatatatagttcaaaaataatagcagctaattattcaaccaacatgataatataactgttacggattcttcacaattattcaatattgaataattcagaatatatatatatatatatatatatatatatatatatncatgtgtacgaacatgtatatgtgtatatatatatatatatatatatatttntatatatatatatgtatattcgcacatgtgtntgtacatgtatataggtatagatgttttttttgacanacatantgtntattagtatatatataaactatagtataaaaatataaatgagtggttcatttactttntgcacacctgactcatngaatcttgctttctaagacataaaatagaataattaaaattngngctcatgtatttnaacaatatactatctatgggggantgtatatgccngcttatctatttnt

SEQ ID NO: 1451 - DNA, 550 bp, Ctenocephalides felis
gaaatatgcatcggtagaatattttaagtttttgtgaataataagttatcgagaatcttcagaaacaatgggagcaggcagcacgatatttagtgcaagacaagtgctgtggtgtatggtgttctgcggattcgccgttaactatatgataagaattaatttaaacatagcaatagtgtctatggtcaggcatcgatctttaattgtggttaacgaaacaattaacgaaaaattgcaattagttttggattctggggcggaaaatgtttcggaaagttcatccagcacccaagcgcctggaccaagcgagatctatcaggaggaagatggtttcatctgggacgaataccagcaagggttaattttaggggcatttttctggctccactggatcactcaagtaccaggaggaatttggctagaaaatatggtctaaactggtgtttggtttgcgaatttctaggtgcttattttgctcatcacccctatcgcgtatatgaatatcaacactatatnctcgagtaatcaggcattgttgcggtttcttggc

SEQ ID NO: 1452 - DNA, 550 bp, Ctenocephalides felis
aattgttgctctgatcattgccggagttgagcttctgggagccatatttgccctgtgtcttgcaaattccatccgcaacgaagataggaggtacgcataagatctacttcaatactgtgtgtgaatatgtaattcgtttttgcaaaatatctattattatgcaaaaacaatcaacaattataccttcaaatttgaaaataataattcgatgtatgtatacaaaagccaaattttactaaaggcttctaatttaagaaatattatataattgagaacatttttatgaactatttaaacgttaggaattatttggagtgttgtcaaatgcttttaaatgtattaatatttacaatttgattattctcaaataacaaatatttttaatatttttgtaatgttattttatatattatcgaagtaaacacaaagacaaaaaatatatctacacatgtatgtatatatatatatatatatatatatatatatatatatatatatatatatanacacangnnnaccncacacacatanatttctatgtgtgtnnatg

SEQ ID NO: 1453 - DNA, 550 bp, Ctenocephalides felis
atttttcgagtgccactaagatggttaaaattnntaatgaaccgcgaaactgggaaagttatggaatagttgatgagcaacaacaaccttcaacctcctctgcaaacctcaattgcctaaatccaactactacttctacttcagaccgtcccgcagcgacggtttccaaaagaaaactgccttcatatcgagaaaaaatgccacgttctcgcacaagatcgcgatcccgcagtcgtcggcataacaatcatacaaatcatcggagggactattctgatgagcgccattctataagagtgaggtcttcttctagaaggaggagacatcatagaagtaggagcaggaatagagacagacatacacgtagganaaacgagagcggagatcatcatcgcagttacaggcgcagttcaggagaaaggagctatcgaagacaccacagacatggagatgattcagtcccgccgaacaagtacgcgtgaaaggcatcaggaaggtcgattnagatgataggaggacatctcatgtcaaacctgngatataattggag

SEQ ID NO: 1454 - DNA, 474 bp, Ctenocephalides felis
gtcncattggtgccttccaaacccatgtgtgtcgaatccttccaggagttccctccattgggtcgtttcgctgtgcgtgacatgagacagaccgttgccgtcggtgtcatcaagtctgtgaacttcaaggatgcctccggtggtaaggtcaccaaggctgccgaaaaagccaccaagggaaagaagtagctagatctaccgatctgcttactgcagatgttcaacactgtaatgaaacactacttccatcgcaaagcgtttcgaagaaaaaaggcctcattcattcctttactatatgttttttgactcagctttatattttatatgactattttatagaataataattattttatgttctgctctatattaaaatgaatttatattaatgtatggatattatgtgctaagaaagaacttgaagagatttgcagctgatgtgtattatagtatggnataaatggaanccaaagt

SEQ ID NO: 1455 - DNA, 347 bp, Ctenocephalides felis
gtttngtctcatgcaataattaattaaacttgtttgttagaggtgcaaaataaaattaaattaaaatgactgcctggagacaagctggtttaaactacattaacttttcaacaatcgctgcccgaatggtccgccaagctttgaaatctgatctaaaaaatgaggctttgaaacgggacgtatctagcattaaattcacaccctggaaggacggaaaagcgatcaaaagtgaaaccaagtaatcacaagatggaataatagacaattcactcaaattaataatgtgtacgtaaccgataacaagaataaatgttagttngatnaaaaaaaaaaaaaaaaaaaaaaaa

SEQ ID NO: 1456 - DNA, 356 bp, Ctenocephalides felis
agtttgctacacacagcacgtgtaaattttcataaaataaattaaaaatggataaacctgtagttcttgctcgcgttatgaaagtcttgggccgtacaggatcccaaggacaatgtacacaagttaaagttgaatttattggtgaacaaaaccgacaaatcatccgaaatgtcaaaggaccagtacgagagggtgatattttaacacttttggaatctgaacgtgaagctagaagactaagatagattaattctaaaatgtgagaggtgatatcctgaactataatatctgggttcaattatttgtatggaattataaatatacgacttatcactcccaaaaaaaaaaaaaaaaaa

SEQ ID NO: 1457 - DNA, 550 bp, Ctenocephalides felis
cttaaccaccgtcacccactcgccaaattacaccatggctgaaccagaaaaggctcctgaacaaccaaaggtgcccccacagaagcaaatcatcgcttcaaaggtgatgggaactgtgaaatggttcaatgtcaaaagcggatatggatttataaatagaactgacaccaaggaagatgtgtttgtacatcaatctgccatagttaaaaacaacccgaagaaggctgtccgcagtgtaggggatggagaaactgtggagtttgatgtggtaattggagagaagggaaatgaggcagctaatgtgaccggcccagaaggagagccagtcaagggaagcccatatgcggccgacaaacgccgcagctatcgccaatggagctccctcgtggaggacccaggggacccagaagaaattacgaaggaggcgaaggtaaagaagggtcgggttcgggaggcgagaacggtgatggcaaggcccgtcaaggaggcggccccgcgtggccgattccgcggtcgccacgatacacactattacggcgtggcggacggc

SEQ ID NO: 1458 - DNA, 550 bp, Ctenocephalides felis
aaataatctctgaaaatgttgaagggcgttgtaggtcttgttactggaggtgcttctggtttgggaaaggccactgtagagcgaattgtgcaacaaggtggccgagttgttttatgtgatttacctaaatcaagtggatctcaagtagcaaaagatattggagataattgtttatatgcaccagttgatgtcacatctgaaaaagatgttgaggaagcaatagcattaactaaagaaaaatttggtcgtcttgatgttgctgtaaactgtgctggtatcggtgtagcatttaaaacatataatttcaataagcagttgcctcataaattagaggatttcacaaaagttttaatggttaatactgttggaaccttcaatgtaattcgattgctgtggattgatgggagtaaatgaacctaataaggatggtcaaccaggagtgattgtaacacacaagtgtgctgcttatgatggcagatgggacaagctcttattctgcgtccaagggctttgtggaatgcactgcttttgctaganattaccaggcaag

SEQ ID NO: 1459 - DNA, 546 bp, Ctenocephalides felis
atttaattaaaatgggtaaatcctaggcaatattagaatatgatgtactcatgagatggcaaatcaaaattttacaagttcagatgcaaatgaagaaaatacaaatgaacctctaccagaatttatttgctcgtgttgttcacttaaacaaccttatgactataaaggatgtaatcctccatttgcaaaaaatatagctacaattgatgaatcctatataatgaaagatccttttagtcctgagaacaaaaatgaaattcttatattgggagccgattgtagtatttgtcaagaatctgtatgcgtatcaaccacttgcagtatatttttcatgaaaactctatgcaagaaatgtgcattgaaacagaaaaacatgtaccctgaacgatttaaacaaattattgacatgtttttaaataaatgcttaggtagttgaataaatgttgtatttaaatttatatttaaaattaactgttaaatattgngaaaaagaaaatatagaaaataattgataaaatgtgggtgatatgaaaaaaaaaaaaaaaa

SEQ ID NO: 1460 - DNA, 550 bp, Ctenocephalides felis
gattcagctttgcatagaattgtagatgcaactgatgcaattgttagcactgcatattcccataaaagaacatttattatggaagtaatgggacgaaactgcggatatttagctgttgttgcaggcttgtgtgttgaagctgattttatatttgcgcccgaagatcctccagatgccaactggccaagtgttttatgcgcactattaagtcaggaacgattagctggaagaaggcaaaatattatcatggtatcagaaggggcaattgatagaaatggagaacctataacagcagaaaaaattaaagaagtcattattgcaggtttaaatcaggatacaagaattacagtgcttgccatgtacagagaggtggaagtccttctgcttttgatcgattactgggatgtcgcatgggggcagaagcagtattagcccttatggaagctcatgatgagtctgaccttgtgttgtgaccttgcccgaaccaacagtcgtcttcaatgatggaatgtgttctcaccaaactgtacttacgcttggaaaataaaat

SEQ ID NO: 1461 - DNA, 550 bp, Ctenocephalides felis
caaactcatcctttgtagaacgtgtcaagaagcgtggattcgaagtaatctacatgacagaaccaattgatgagtatgttatgcagcaaatgaaggattacatgggtaaaactttagtttctgtcacgaaggaaggtttggagttgcctgaagatgaagatgaaaagaagaagcgtgaagaggataagactaaattcgaaagcctttgcaaggttatgaagaatatcttggataacaaagtagagaaagtagttgtgagcaaccgattggtagattcaccctgttgtattgtaacatcacaatatggctggacagccaacatggaaagaatcatgaaggcccaagctcttcgcgattcctcgaccatgggttacatggctgcaagaaacacttagaaattaaccccgatcattctgtgattgatactttaagacaaaaggctgatgctgatccaaaggataaggccgtaaagatttagttatcttacttttcgagacagctttgctgcatctggtttactttagatgaaccccaagtccgctnaagaatt

SEQ ID NO: 1462 - DNA, 312 bp, Ctenocephalides felis
attgnaacttcaagaattgtacgtaaaggctttgactaatgaggagtgcaaagctaaatcaccaattccaccaacgacccaagtctgcacacttttggaaaagaatcacggagtatgctcgggagattctggtggtccattgcttttggatggcgagcaagttggcattgcctcatttgttatcttcaaatgtgcaatgggataccctgactatttcacaagattgtctctatatgtagattggattgaacaacacatggattaaaaataataaaataataatttaatgtaaaaaaaaaaaaaaaaaaaaaa

SEQ ID NO: 1463 - DNA, 550 bp, Ctenocephalides felis
gtcaaacatcacaaaaatatatagctttatgtgtcacaaatgattacacttttatcgttatgatataatacaaaataaatacaatttcttacatgctattattataattcaatattaaaacatttgtactataatataacaatgaatttcttatatttattaatatgctctctttgtgcggtagtaaatgccggtggggatacattagttttattagacaatcttgcaattaaagaaactcattccatattttttaaaagcttacaagatagaggttatgttctaacattcaaattggctgatgaagccaatttagttttatctaagtatggagaatatttatacaagcatttaattctattttcacctgctgtggaagagtttggaggatcattaagtgtcgaggcaattcagaattcatagatgaaggtggcaatgttttggtagcaggaagtgaatcctggtgatgcaattcgtgaatagctctgaatgcggtttgaggagatgaggaaggacactgtatggacatcttaatatgatggtctgataa

SEQ ID NO: 1464 - DNA, 550 bp, Ctenocephalides felis
gtcgttttacatgcgccggacagacatacttcagcgcgctttaccaacaatgcgtgcaagcgcctttatccgagtgcttggcgacagctgcacctccaccaccgccaccaggaccaggaccatcgcaaccctttgcttgcgtgcggacaggattgtttttggattacactgataattcttgcaaatggtactacgagtgcacattaaacgctcaaggtgtattcgacgtggcccgatatgcttgtgcagctgagttatatttcaacagcgttctgcagcagtgcgtacctgcataccagtcagactgtttaggtgcaagtgtcacttcttccccatccataccatccttaccatccttaccatctttcccaaccttgccaacatcttccccaacagcaggatttccttttggccgaaaatctcttgatatgcaaacaaaaactggaactaaatgtacaaaaggagaagtttctaaagacgattaaattctacatgtcctagtgagtgtgtatatgaaatgctattgatatacatcaagcttataaggtat

SEQ ID NO: 1465 - DNA, 550 bp, Ctenocephalides felis
cgttaacgttggtttttcgtaacgtattatatatacaagtgtgtggattaattaaatatttacaatggcaactgaagtggtaaacaacgtgcaagtcaccgagaaggatgtcaaagaggagttgcccgagaaaaaaattgaagaagaagccccggccacagagaaatctgaaaaggccgatgaggctccggcttcgaagaccgagcctgcaccaccgaaggtgctcgtgcataaaacaaacttcgaaaaggataccgtgtatctttaccaattctccagaactcctcttttgccatcgatgtcgccgtactgcttgaaagtggagacctggttgcgtttggcaggaatcaaatacgagaatgtcgaccacaagatgaaattccgcagcaagaaaggacaattgcctttcgtcgaattgaatggtgaagaaattgctgcagtgccatcatcatgaaggagttgtcaaacctacggaaaggatctggatgctgtttgacaccagacacgcatgtctccatgctatggatccatgattgaaaaccacttgtat

SEQ ID NO: 1466 - DNA, 546 bp, Ctenocephalides felis
tttttttttttttttttatttgcattgngatagccggccgattgcattcagttctaaaatgccgatcaaaagtatcaaagctcgtcaaattttcgactctaggggcaatcctaccgtcgaagtcgatttagtgaccgaattaggattatttagagcagcggttccttcaggtgcttccacaggagcttatgaggctcttgaattacgtgataatgataagactcaatatatgggtaaaggagtatccaaagcattgcacaatattaatcaattgattgcccccgagttaattaaacaatcttttgaggttactcaacaggaagagatcgacaaatttatgttgaaactggatggtactgagaacaaatctaaatttggagccaatgctatattaggagtttcattagctgtgtgcaaagctggtgctgctaaaaagggtgttcctctgatcaacatattgcagatttggctggaaataaaaaaaatgngcttcctgtccactttcaatgtatcaatggcggagcatgctggaataactgtttcaga

SEQ ID NO: 1467 - DNA, 550 bp, Ctenocephalides felis
gtaaaataattaatttattgttaattacattataaaataagctaatatgtaactcatcacaaaaatagcatttaataaattacaatggcccacctaaacaagagtttgaaaccaataaattactccaacacgtcattcagacacttttttcttgtattatttttcgtattggttttcgccctcagtattgctttattagttttatttccatatagtggaaaaagacatgaaatctataaggatataagtttggaagatgtcataaacgttccagaacaaatcattcatgatcaagctccctcagcaaatcctcgcaatccaaaatgcagccactgggattgttttaatgtgtatcgctgtggcaataaagggcacaatcaaatatctatttatatttatccaattaaaaaatatcttgatgctgatgatatacctgcactggtatcatgtgcaaagaatttattttattttaaaaactataaaagatncaaatttacacatcaaatctgatgaggctggatattggtccaagattgtacttaaatcaaac

SEQ ID NO: 1468 - DNA, 550 bp, Ctenocephalides felis
gaggaaagnggcaaagatgatgacgaggatanggaagcaactgaaaatgacacaacaaaagcagtgcctggaatttcttttgtcaaattgacatgcgtgcattgctctacaaaatgtgctacattgaaggagtatgttacccatttgaggagcaaaatacacaactcatatatgagccgtttagctgcacgtcacaaatctcgattggccaaaatgcgcgcacaacagaggaatgctcagcgagagatcgatgaaaagaatcaggaggactattatttaaagacaaagttttgtcctacttgcaaacttaattacaggcaactcagagctgaacatcaagcttctgaagcacataacgatattaagaagtatttgaagccttattgtaggacttgtcgtatgactttttcaagtcctatgcgttatgaagtacatatttgttcaatgcacacataaaacataaagctcatctggagtatgtaaaacacaaaaaacaagatatgaagaagttggtagtgatgaagctgaaagaatggattggatatttatg

SEQ ID NO: 1469 - DNA, 550 bp, Ctenocephalides felis
cagaagctcaagccagagccgaagaagtcgaggaaatcaggaggaaatacagtgccagaatccaagaacaagaggagcacatcgagaccttgttggtcaagatcagcaatctggagaaacagaagagcagactgcaaagcgaagttgaggtcctcatcatcgatctggagaaagcaaacagcgctgcccgcgatttgcagaaacgttgcgagcaattggaacgtgtcaacatcgagatcaaatcacgtcttgaggagaccattcagttgtatgaaggagcccagagagatttgagaaccaagcaacaggagttgcagagggtcaaccacgaattggacaagaccagggaacagaaagatcagttggccagggaaaacaagaaattgggagacgaattgggagatgctcgcaaccagttggccgaatacaacagacgtttgcacgaattggaactcgaattgagaagactcgagaatgagccgaagagttgctgctgcatcaagaggccgaactgtcgcaaggccaagacacgttccacgttggcnacgat

SEQ ID NO: 1470 - DNA, 550 bp, Ctenocephalides felis
gcaantcgcaaacgagtttcagagcacagcggctgcgcatctgttaagctcaacggctatagtttttcagtattataatttgtattaagtcgaagtaaataacaaacatgagggaaattgtgcacattcaaaccggacagtgcggaaaccaaattggagctaagttctgggagatcatttctgatgaacatggaattgacccaactggagcttatcttggagatcatgaacttcaattagaacgtatcaatgtttattacaatgaggcttctggtggaaaatatgttccacgtgccattcttgtggatttggaacctggaaccatggactccgtgcgttctggaccatacggtcaaatttttaggccagacaattttgttttcggacaaagtggtgctggtaacaactgggctaagggacattatactgaaggtgctgaactagtcgactctgtttggatgttgtgcgtaaagaagctgaatcttgtgattgctgcaaggttccactacccattcttgggangtggnctgcttgnatgggacactattga

SEQ ID NO: 1471 - DNA, 550 bp, Ctenocephalides felis
ctgtgccagacatccaaaaaccagctcctgaatttgcaggtactgctgtagttaatggtgaatttaaagacattaaactcagccagtacaaaggaaagtacttggtactattcttctatccattggacttcactttcgtgtgtccaactgaaatcattgccttctctgaccgcattgatgaattccgcaagattggatgtgaagttgtagcagcctcttgtgattctcactacagccacttggcttggattaataccgcacgtaaagaaggtggcctgggacaaatgaatatcccacttcttgctgataaatccatgaaaattgctcgtgattatggagttttagacgaatcatctggagttccattcagaggcttgtttatcattgatcccaaacaaaatgttagacaggtcactgttaatgacttaccagtaggcagatctgtagatgaaaccttgagattggtcagccttccaattactgatgaacacggagaagtttgccactggctggagacctgtagtaaaactatgaaagcggaccaaacttc

SEQ ID NO: 1472 - DNA, 550 bp, Ctenocephalides felis
cagcaactcatttaatatttgtggatcctgatgcgaaaaatgaaacatggatattacacacacatattgcagcagtagaacgattaccgttgagtactacaggatgcccacttcaaattcgatgcaaaacattccaatcagtaatatttcttataagaaaagaaaacgatagccatgacgtttataatactttgttgcaattagcccaacctgtttctatcgatgatctgtattgcttccagtacaccataaataaaaatgatatgcataagagcgaaggttggaattattttaatttagaggatgaatttaaaagaatgaatgttccaaatgatgaatggatttacacagatttaaatgaaaattatgagctatgtgatacttatcctaattgttgtatgtgcctgctaacagcacaataaatatgttacaaggaagtgcaaaatttcgatccaaaggaagataccggtctcacatattacacaagaacaagcttcaatatgcagatcagcaacctttctggttcagtgcacgatgtctgagatgacaa

SEQ ID NO: 1473 - DNA, 550 bp, Ctenocephalides felis
aaaattttaattttaattattatgtgttcctttatcattgatgcgagaagtaaaagtttcgaaataaagttaagacggtggaaaagtcctcgacttcaattgattgaaatggatcgaaatatgcgtatagcggtttggaaagatattcaagaaaacgaaagctattattcggatccatctaaacctaaacctcctccaggtcctaaggacaatgatactatagcaatttataaatttttagatactgaattttatgctgaggttggaataggccatcctgtaaagtatttcaaacttgtggttgacactgcatgggcagaaacatgggtggcctcgaaacaatgtgggttaaagtgtgttggatgttggaatcttaataaatatgactctttggcatcatcaacatttcaagaaaacggtaaagaattttcttttggctcagcaaagaaccataacagggtcttctcaatagaaagttttatattgccacataaatgttaaaatcagactttggggaagtacatgtttgccttgcactctgtttcaaaca

SEQ ID NO: 1474 - DNA, 550 bp, Ctenocephalides felis
ccntaccgccgatttgttcgaaagaagaaacatcgtccaagtcacactttgtttatatgctttgggcagacttacacaaaaacatcccgaatacacaggaccatcattaggccccaaaatggcagaaaagaatgaaaggacgtttactgaagagcaacttagagcccatgaaggagaattgaacttgcaaatgggatacaacaaaggtgcatcccaatctggccatggtggatttggtaacactaggcatatgtaatttgctgattttatacgtatttctgaaaatattcctcacaagtctgacgacgatacagattagtagattcgagcacactttgttcaatgttattctgatacagactcaaaattaacacaaactaacagaataaacacgacattcacaaacactcataactaatagatatagacacaacactaattttaacacaatccaatacataatgacatataaaaataaattaacatctctcgcattaatacgatacaaaaatttaattactaacaaacataatttacatattgaaatctt

SEQ ID NO: 1475 - DNA, 542 bp, Ctenocephalides felis
agctcacagaattcagggctagctttaaccacttcgacaagaaccgcacaggacgtttggcgcctgatgagttcaagtcatgcctggtttccctcggctactcgataggcaaggatcgtcaaggcgatttggacttccaaaggattttggcagtagtcgatcccaatggaactggatacgtccacttcgatgcattcttagatttcatgacccgcgaaagtacagacaccgacactgccgagcaagtcatcgacagcttcagaatcttggcctccgacaagccatacattctgcccgatgagttacgcagagaattgccaccagaccaggccgaatactgcattcaacgtatgccaccttacaagggacccaatggtgtacccggtgctctcgattacatgtccttcagcacagccttgtacggtgaaagcgatttgtaaggtagaataaattttcataaacatttaagcaaacatttgacaagtacacataaaggtaaataatgaagttatgagagttacgatcaaaattagcattgngct

SEQ ID NO: 1476 - DNA, 542 bp, Ctenocephalides felis
gtttatcggtgtcttgggtcatgggaccagngnggcatcattaatcatgaatttaaatagtgtcgttactaatttctcaggtcttgtgacgagtccgatgttgaaaaagtattccgttcggaaagtggcggtggccggatcgctcctgaccgccacgggtctcatgatcagcagtcaggcacgctccctgtggctgattctgtttggatacagttttttgacaggtctaggtttgggttttataatgccttcggtgttcttggcagtgacctcttattttaaggtgctccgaggccgggcggtgggcctggcagcagccggtaccggcctgggacaaatggtaatgcctcatgccgntcgagcactgttggacgaatatagtttcanaggagccactcttattatggccgctatggctttacaaggggtggtaggcgcttctttattcaacccgtaaagaatacatgaaccngtcnatgacgnccgaccgagaaaaaatntttactngaccngatttacccctgacgctcagacctgaagaa

SEQ ID NO: 1477 - DNA, 542 bp, Ctenocephalides felis
ctccattctttcttaggtttcattcttttaagctgaccatcccaaaccaaatcaaccaaccctccttgtttggctatcactgctttcacacgatttgcaaagtctattgaactctctttttcttctctaaacattggaggtaagtaccaaacatcacatacaatcgcccatgaagacatcatcatgtataaataatgcatcattgaatactttgaactgttccaaaaggcatctccaaactttggatcatatttgatggctacaggataaattactcctccgacttcaaatgagccttttttaaactgcattaccgatgtattattgatacatgttccttctggaaatattaatattggtggattattaggatcagagatatgctgccgaagtctgtagtgacggcagttcgatctttgacttcagagcgttcaaaccaaatgtgaggtgatgccctagccagcgccctttgcagtatacctaggaaaccatcatgtctctgccaattagagaatagcaattatcacacatgagaacaagag

SEQ ID NO: 1478 - DNA, 542 bp, Ctenocephalides felis
cacnaaggcaaaagtttgtacatttccaaagngatggattccaaaccctttgatcccgtggaaaatgggctcgataaagacttcaggcttactaaatttactgaattaggagggtgaggttgtaaggtccctcaagatgttttaaacaacttacttgagggactctgcgatatggagaaggccaagtccagtgatagtaaggaagttggaattggattggactgctccgttactcctctcgaagaaaactggtaccttttacaaacaacagattttttctatcctttaattgaagatccatatttaatgggtcgaattgcttgtgcaaatgtggtcagcgatttgtatgcaatgggtgttaccaaaattacaaacatgatgatgttattaggcattagtaataaaatgactccgaaggaacgagattgtgttattcctttaatgatgaaaggatttaaagatggtgctaaagaatcagatacaactatccaggtggacaaacagtcttgaacccttgtgtattattggtgggtcncacatca

SEQ ID NO: 1479 - DNA, 542 bp, Ctenocephalides felis
gntatggaaaaagccgaaaagctgggccatcgcgttcaaaaatgtgtggttgtcgctcatctgaaacgtgtcactcctggaaccagcgaggagatcaatggagtcgagactcctatgacagatggccgcgaccattggtggcatgaggaaatggacgaagttgaaccagcatgttacccagaatggatggctgctgaggatccattgttcatgctttatacaagcggctccactggtaaaccgaaaggggttctacatactacaggtggttatctattgtatgctgccaccacatttaaaatggtttttgactacaagcccgatgacatctactggtgcactgctgatgtaggatggattactggacattcgtatgttgtctatggaccattagctaatggcgccacctccgttatgtttgaagggacgccattttatccggataacgatagatattgggcggtattgaaaaatacaaagtgacccagttttacacagcaccaaccgcataagacttgatgaagttcgggaagaccagtcaa

SEQ ID NO: 1480 - DNA, 542 bp, Ctenocephalides felis
ttgagaaacttctcaaaattgataaaaaagntgctgtagtaatggccatggatatgttgttagcaggagttgatactacatcaaatagtacagcatttttgctgtatttcctggctacgaatcaaaaatgccaagataaactacgtgaagaaatcagaacaattctgccaaataaggattcacatgtaaataacgaatcatttcaccatttgccgtatttgagagcttgtatgaaagagtcgagtagaatattgccaataattggaggcactgttaggaaagtaccagtcgatattgttttatcaggatatcaaattccgaaggggaccgaggtggttctaagtcatcttactacatcaatgaaaagcagtcaattccctgaacctgaaaaattcatgccagaacgatggctgagcagccaggaatcagaaggatgtcctttagcaaaaaatgctcatccattttcgcacatgccttcggtttgggcctcgcactgcgtgggaaaagattgcagatttggaaatggaactttatatgaagta

SEQ ID NO: 1481 - DNA, 539 bp, Ctenocephalides felis
taaaaattttaatngcttattcttcaggngttcatataagaatagtattaggaggaatttttactataaatatattaggtattgtaggtaggtttattttaataatttctcatggattatgttcttctgggatattttgtctttctaatattatttatgaacgatcaggaagacgaagaattttaattaataagggtttaataagatttataccttcaataacattattttgatttttattatgtagatctaatatagcagctcctccttcattaaatttattaggtgaaattatattgattaattctataataagttgatcaataatattaatagtattaattataataatttcatttataagagcaaggtatagactatatttatttgcttatagtcaacatggaataagaagaataagactatattcttgtcttctggaagggttcgagaatatttattattatttttacattgattccattaaattattaattttaaaaagagattattataattatttataaaaaaaaaaaaaa

SEQ ID NO: 1482 - DNA, 540 bp, Ctenocephalides felis
ctaatcgaagtgatcgtaaaatattaaatngacagctatttgttaaaacaattgtgcattatagaaaaacatttaagtgaaaattaattacgtttcagcagaaatacatcttctttgtaaatttggggttaataatctttcaaaatgcagatctttgtgaaaactctcacagggaaaaccattactttggaggtagaaccttcagataccattgaaaacgttaaagctaagattcaagataaagaaggaatcccaccagatcagcaacgtttgatttttgctggtaagcaattggaagacggcagaactttgtctgactacaatatccaaaaggaatcaacattgcatttagtattacgtcttcgtggaggtatgcaaatctttgtaaaaacattgactggaaaaactattacattagaggttgagccctctgatccattgagaatgtaaaagctaaaatccaagataaagaaggaattccccagatcagcagcgtttgtctttgctggcaaacaattagaagatggaagacttgtctga

SEQ ID NO: 1483 - DNA, 542 bp, Ctenocephalides felis
gtnacattgatcggatctgttagcaaaggctnccaaantgccgaaatcgatgaatgttcgtgtgaccacgatggacgcggaactggagttcgcgatccagcagaccaccactggaaaacagcttttcgatcaggtggtcaagacgatcggtctgcgcgaagtctggttttttggactccaatatactgacagcaagggtgatttgacgtggattaagctttacaaaaaggtcatgaatcaagatgtcaaaaaggaaaatccacttcaattcaaattcagagcgaaattttatcctgaagatgtagctgaagaacttatacaggacattacatctcgtcttttttatcttcaggttaagaacgctatactgtctgatgaaatatattgccctcctgagacatcggttcttctagcatcttatgctgtcaagcccgacatggagattttcaaaaagaccaacactcttctggattttggcgaacgatagactgtaccacaaagggtaatggatcaacacaaaatgtctaaagaagaatgggaac

SEQ ID NO: 1484 - DNA, 542 bp, Ctenocephalides felis
cagacactgacaaaggcaaaaatgggtcgtcgaccggccagatgttatcgctattgcaaaaacaagccctaccccaaatctcggttctgtcgtggtgtgccagacgctaaaattcgtatcttcgatttgggtaagaagaaggcaggcgtagaagattttccactatgtgtgcatcttgtatctgatgaatatgaacaattgagttctgaggcactggaagcaggacgtatttgctgtaacaaatacctcgttaagaattgtggtaaagatcaattccacatcagaatgaggctgcatcctttccatgttatccgcatcaataaaatgttatcgtgtgctggagctgataggctccaaactggaatgcgtggtgcttttggaaaaccacaaggtactgttgccagagttcacatcggtcaaccaatcatgtctgtcgttccagtgacagatacaaggccgctgttgtagaggctctgcgtcgtgctaagttcaagttccctgcagacaaaagatctatgttccaagaaatggggattcactaa

SEQ ID NO: 1485 - DNA, 542 bp, Ctenocephalides felis
cacaagttctattcaaccagatagaatcttacttatggatacgtttttccaaattttgatcttccatggagagactatagctcaatggagagctttgcgatatcaagatatgcctgagtatgaaaatttcaaacaacttttgcaagctccagtagatgatgctcaggaaattttattgacacgttttccaatgcctcgttatattgataccgagcaaggtggatcacaggctcgatttttattatccaaagtcaatccctcgcagacacataacaatatgtatgcttatggaggagacggaggagcaccagtattgactgatgatgtgtctcttcaagtatttatggagcatctaaagaaattagcagtatcttcaaattcataaaattatataaagacagaaatagatatacaaatcttattttatctgtaatattgtgtgtcagtctttatatttgcaatatagataagtaataaattcaattgattatgaacctaaatacattgatatattaaaagaacatttacactaaaaaaaaaaa

SEQ ID NO: 1486 - DNA, 540 bp, Ctenocephalides felis
acagttaaagtgtattcaaatcaaataattccataaaactattctagaaaattatccaacacagttagataagatgaagtctttggtgctcttggccgttttggctgtaggttttgcaaacgctgaatattgttacgatgaaagtgttactgcttgttcatcgactgccaataaggaggatctcccccattgtaacgctctctactccggtttccacactgtggctgccgatttatcatcatacgttaaaagagaagtcctatactcctacgactacttgctgatgtccacacactttggaaactatgaaaagaatcgtgttggctttgaaaaactcttcaagggcctctccgacaagtcttgggaaaacgcaatcaatgtcatcaaatacatcaccaagcgtgggggcactgtcgacttccagactactcacaacgtcaacactacccgtgtagccgaaacatcagaattggaaagtttggctagggctttggagaatgagaaagtgctcgctaaggatgccaggctattcacaaacgt

SEQ ID NO: 1487 - DNA, 542 bp, Ctenocephalides felis
caggagaaagcttcagttcgtgcacactaaatgtgttagtaccaggcgagaagaaaaagacaccagctttcagcactttcccagagtccgccagcgtgcaagagggcgagagtgcatcgttcttagttcgcacagaagacgaagttcttggacttcaatggataaaagatggtaaacctattgacgagaagagctctcgctatcgattcacaatggagggcaaaacgaccttccgattagagatagtatcctgcgccagcatagacgtgggccaataccaagccaaagccatcggtaagacaggagaaacattcgctgcgttctcagtgaatgtcgcagccgagcattgagccgaacaactaaattaataaccgatcctgcacacggcttaggccaaaaaacgagacgactcgcgttgaatcgcgagatatcgtgtaaacttaagtttattaaattattatgtttatatgaataaattattagtgtgatctaagcgtgttttcattataattcgccttgccacttcgcttatatatangccg

SEQ ID NO: 1488 - DNA, 542 bp, Ctenocephalides felis
atcagctacgcagagccacttccatttcactcctggacgagtcctttgttgtgtccggtgaacgtagagatcagggcgtggtagtggccttgaaggatggttttggctttcttcgttgtgcagaaagggagccaagactgtttttccactttaccgaggttttggatgtgacgagagagatctccatgggagacgaagtggaattcacagcagtacaagatcctaatagctcttttgctaattttagacacagcgctataaggattaagcatttacctccgggtactgtaaaattcgaaaccctaatcgaatcaaatctaacgggagtcgtgactagggaagcctctccaagaagccctagcaaatctcaaaacggtggtccaacacaaaacggcgggcctccagttccagaagggggcatgatttcttatcaaagcaacggtcaaaagaaatcagttcctttctttgcaaaagattgtgatcggcaacctagaatgggtgataaagtgatttcaacattagtcaggttaagcgtaataaag

SEQ ID NO: 1489 - DNA, 542 bp, Ctenocephalides felis
gttttggtcagcctgaaattgcaattggaacaatccctggagctggtggcacccaacgtttgaccagatctgttggcaaatctaaggctatggaaatatgtcttactggcaacatggtcacagctgaagaggccaaaaaaatgggcttggtaagcaaggtattccctgctgataaattggtcgacgaaactgtaaaattagcagacaaaatttcatcacattctccacttattgtctcattgtgcaaagaagctgttaacactgctttggaaacttctttgcaagaagggttacactttgagaagagagcattccatgctacatttgccactaaagacagattggaaggtatgactgctttcgtagagaaacgagcacctaactttaagaatgaataaaaagactactcgaattttataactctatatgtatatattttacattacctttgtaataggtaatatgaataacctctttatttacatgcatttgatatacttaatgatatttgatatattccttatatgatgattccattattg

SEQ ID NO: 1490 - DNA, 542 bp, Ctenocephalides felis
cgaaaccataaaaaaatacggcaaactcaatgncctcatcaacaatgccggcatgttggaaacaggcaccatcgagacaaccagtctagaccagtacgacagaatcatgaacgttaacatgagatctgtgtaccatttgacaatgttagcagtgcctcatttgattgagacgaagggaaatattgtgaatgtctcgagtgttaatggtatacgttcttttcctggtgttctggcttataatatatccaaagcggctttggatcagtttacaagatgcgttgctttggaacttgctcttaagcaagttcgtgttaattctgttaatccgggggtcattattactgagatacataaacgggggggaatggatgatgaaacttataaaaaattcttagaacattgcaaaactactcacgccttaggacgtccaggacaagtaagtgaagtatccaatgccattgcgtttcttgcaagcgagcacagcagctttattactggtgcttcgttaccggtgatggaggcagacatgcctgtgcccacga

SEQ ID NO: 1491 - DNA, 542 bp, Ctenocephalides felis
gnnaattattttattaagcgcattatttgcgngtgtnatttgctcctttaacgcggaagtacaaaatcgaatcgttggtggcaatgatgtaagtatttcaaaaattgggtggcaagtatctattcaaagtaataaccaacatttctgtggtggttcaatcattgctaaagattgggtactgacttcttctcaatgcgtcgtggacaaacaaagtccaccgaaggatttaactgttcgtgttggaactagcactcacaatgatggaggaaaagtgtatgatgttattgaaattataaaacatccgaaatataataaagcagtgccagatgattttgatgttgcacttttacggatcaaagagccaatatcatttactccatgcacagtaactcctgtaaaattaatacaatcgggaaaagaagtccgaagggaacaactttgagtgtaactggatggggcccacgaangaatgggggccaatttcgcaaagttcaagaagttaaagttaaagcttactcaagtcaagaatgcangaacagcat

SEQ ID NO: 1492 - DNA, 542 bp, Ctenocephalides felis
aaaaaaacaagcttttttaacgaaatatttngcaaaaagagaaatatataaacaaacttaatgtctgaaacaatataaaataatattttcaacgctaacgcttaaataattccaaaacaaatcatgagtgactattttcttttatgttaacctctttacgcaaagaaaatgtttataaacttcaaacaacgttaaggtgataaatgtttacctaataataataataataagtttattttgattttgtgtataaaaacatgtcttggaggctgctgttgaagttttaatttgcaagtgttagatacaacttaataaaaaatgtctcaatgatgacaataacaaaaaattcttttacccaagtgcctcttgtatttataatatgatatacaaaatgcccccgtttagacgtaaaaaatctggaaagtcttttccagttaaagtttgcactttggacgctgagttagaatttaatttggagtggaaagcgacaggcaaagatttattcgaattagtttgccggacgattggttacgagagacctg

SEQ ID NO: 1493 - DNA, 542 bp, Ctenocephalides felis
agttcatcttatgttgtaattatattatcagnttgttgtaaacacttcttattttatatcataaatatcgctgtatttgatttacacgatggctgcaagattgaattcattgtttaaaacagatttcacaaattacataaaacgtttaaacagcgttcaaatacgttgcttaaatttgcaagaatatcaaagtaaaactctacttcaaaaaagtggcgttgccgttcaagcctttagattattagataacaccgaaaacacaagtgtcttaaatgatttcaaagtccccgaatatgttatcaaggcccaagttttagcaggaggtagaggcaaaggccattttgataatggctttaaaggtggtgttcatataacaaaggaccctaaagaaatattgccaattgctaaaaatatgatgggtcacagacttattacaaaacaaacaaaagctgaaggtatacttgtcaaaaagttatggtgcacaaagcgttgacatttgcgggaaacatattatgtatcatcatggcagagctcatatggcc

SEQ ID NO: 1494 - DNA, 542 bp, Ctenocephalides felis
gtncgattgatttggtgctaattcgattcagntttgcatcagtcacagtcaaagtcggtaataaaatatggttactaaagcagtttgcgttttaaacggggaagttaagggaaccatttacttcgatcaaagcggtccagaagcacctgtcacactaacaggatgcgttagtggtttaagcaagggtgatcacggtttccacatccacgaattcggtgacagcacaaatggatgtatttcagctgggccacattttaatccccacggtaaagaccatggaggacctgattctgctatcagacatgtcggcgacttgggaaatcttgtagctgatgccgatggaaacgctaaagtgaaaataaccgacagtcaaatttccttacaaggtcctatgagcgttataggcagaacattggttgtacatgctgatcccgatgatcttggattaggtggtcatgaacttagcaagaccactggtaatgctggagctcgattggcttgtggtgtattggaatctgcaaaccttaatttaaaattgtatg

SEQ ID NO: 1495 - DNA, 542 bp, Ctenocephalides felis
attcggtgccagtgttccagaatcatggaaaagattagatggtagaatcgtaggaggacacgataccagcatcgataaacaccctcatcaagtatctttattgtactccagccacaattgtggtggttccttgattgccaaaaactgggttttgactgcagctcattgcattggagttaacaaatacaatgtccgtgtaggaagttccatcgtaaacagcggtggtatcttgcataaagttaaaaaccattacagacatccaaaatacaacgcagctgctattgactttgattacgcactcttagaactcgaaactcctgttcaactcacaaatgatgtgtccatcataaaattggtcgatgaaggagtagatcttaaacctggtaccttgttaactgttactggatggggatcaactggaaatggaccttcaaccaatgttttgcaagaagttcaagtaccacatgtcgaccaaaccacttgctccaaatcttacccaggaagtttgactgatcgatgttctgcgctggttatttgggaca

SEQ ID NO: 1496 - DNA, 542 bp, Ctenocephalides felis
gttnccttgtctgcagctattcctcactccagcagagtcgttggaggactggaagctgcagagggttctgcaccttatcaagtatccttgcaagttggcaacttccacttctgtggtggttcaattctgaacgaatattgggttttgactgctgctcactgtttgggttatgacttcgacgtggtagttggaacaaacaaacttgatcaaccaggtgaaagatacctcgtagaacaaacttttgttcaccaattcgaccaggaatctttaagacacgatcttgctttggngaaagtgccagccctatcngaattcaatgattatgttcaaccaattccatttgggcgaaacttatgttggaggcggtgaantgctcgcttactggatgggggaagactggaactacttgaatggaccaatgaactccaagacttacactgtacataaancacaacnatgtgtaagnaacaattntccagttacncagcactttgannnttggtgcagngacnagccctncaccgtgactntggtgnccttgg

SEQ ID NO: 1497 - DNA, 542 bp, Ctenocephalides felis
gcccgagttagacgcgtttgtgaaatctagagttttttatttagtaaattcgtgcttcgtgttgaatatattcgtgatgtctggacgacgatcgggtactggaagaactggcccggcctataactcccgagcgagtactgggggtcctaataggcactacaacgatggcaatcgttataataatactaggagtaactcaaactacaaccagcaggaacagcaacaacagaacaatcagcagcaatatccacttgctcaagcacaagctcgcaatcaaaatacatacaacaaaccggttgaagtaaaagaagaaataaaaccggaagtaatgccatcacctcaaccacaacgtcaagctccaactccagttccagcgccagctcctgttgctacaactcccaccaaagtaaaggcagatgaaccccccgcgcaagagcccgttcagaaaccagaagcaatgcaagaagatggtggagatggtgataacgataaaaagcctggaagaaaaacaaattgataagtgaaaaactagcaacagcgaa

SEQ ID NO: 1498 - DNA, 542 bp, Ctenocephalides felis
gnntttgcaagctttgaagagtgttatacgagaccagttgataaaatatgattttcagtattatcatgttgattttcaatgtgatattcctgtattagtatttagcgagggcaaaagtattctggatattaaaaaccaaattcctttggagatagatgaaaacatcagggacaactttgaaaatattttaccagctgttaaacagtttttaagtaatgaaactatggatctcattagatgttatttaacaatcatgaaatactcagaatttgaagttaatcaggaattgcatgagattatagaaaatgattttgtgaacttactgcaagaaccaggaatgactccagaagatctacactcatatttaacactggccagattgtatagtttatcccgaggtctaaggcatttaacaaaagactcctgcaagcagttaaagatcttgagactaaaagaagatctagaatcaaagccccaaacacactgcgaaatgtgaattgatataaagtntttcattcttgngatatattaacttgttttga

SEQ ID NO: 1499 - DNA, 542 bp, Ctenocephalides felis
atnacttcaagttttgtctgcaatatataaaaatttaagatggctaaagcaccagcagttggtatagatttgggtactacgtactcctgcgtgggtgttttccaacacggaaaagtagaaattattgcaaatgaccaaggaaacaggactactccttcatatgtcgcgtttaccgatacagagcgtctcatcggagacgccgccaagaatcaagtggccatgaaccccaataacacaatttttgatgccaaacgtcttattgggcgtaaattcgaggaccaaacagtccaagctgatatgaaacattggcccttcgaggttgtcagcgatggaggtaaaccaaaaattagagtatcgtacaaaggagaatccaaaaccttcttccctgaagaagtcagttccatggtgttgactaaaatgaaggaaaccgctgaagcttacttaggcaaaactgtgaccaatgctgtcgttactgncctgctacttcaatgactcacacgtcaagccaccaaggattcgggactatctcggtctaaatgtgt

SEQ ID NO: 1500 - DNA, 542 bp, Ctenocephalides felis
ccaatttatataaaagaatttaaaaaaatataaacatgaagccgctgatacttcaagggcacgaacgttccataacccaaatcaaatacaacagagaaggcgatttattattttcggcttctaaggatcacaaacctaatgtttggttctccttgaacggtgaaagactcggtacttttaatggccataatggtgtggtttggtgtatagatgtggattggcaaagtactagatttatgtcaggaagtggtgaccggtctctgaaattgtgggatttggaactaggcaaagaaattggttcaatacctgcccaagcatctgtgaggacttgcaatttctcattttcgggcaatcaagcagcatattcaaccgatagtagtaaatcctcatcttgtgaattatatattattgatgtgcgaaatgcagatagcagtatgtccaagctgatcctattttaaggataccaattccagaatctaaagttacagcaatgttatggggtctttagatgaaacagtattaacggacatgaaaatgggtca

SEQ ID NO: 1501 - DNA, 542 bp, Ctenocephalides felis
gagaaaagagtggaagaatttaaattaaagaaaatgtggaaaagtcccaatggaactatcagaaatattctcggtggcacagtcttcagagaagcaatcatctgcaagaacataccccgattggtaacaggatggaatgagcccatagtcatcggcagacacgctcatgctgatcaatacaaagccaccgacttcgtggtaccaggaaagggtaaattagaattgacatttacccccgaatcgggaagtccaatgagcttcaccgtccacacttaccaaggacctggagtcgccatgggaatgttcaacaccgatagttcaattgtagatttcgctaatgcctcattccaatatgccttaaaccgaaaattgcccttgtacctatctaccaaaaataccattctcaagaaatacgatggtagatttaaggatatattccaggaaatttatgacaagcaatacaagaaagaatatgaagctgtggaatctggtacgaacatcgactgatcgatgacatggtcgctacgcaatgaaatcatctg

SEQ ID NO: 1502 - DNA, 537 bp, Ctenocephalides felis
tttttttttttttaaatattagtgtaacttttaataaaattatttactcaatatcttaaaattgtttgtgatggcacatgttttataactgttttgaaaatttcgagtcacttcttaaagttaaaatttaattaaagtcagtgtagtggtaataaataaattttggcatcaaattaagtattggatatcatggcgaataataatgtgataaattttggggcaggacccgccaaactcccagaagaggtgatgcttgaagtgcaagaacaattggtgcattatggtgaaacaaaaatcagtgtaatggaaatgagccatcgatcaaaagactacatgaaaatcaacgatgatacacaaaatgcagttaaagaattattcaaataccggacaattcaaaatactatttctgcaaggaggtggcacaggatgtttgcagccataccactgaatattttgaagactggagttgcagattatgttgttacaggttcttggtctgcaaaagctgcaaagaagcaccaaattggnaagtaacat

SEQ ID NO: 1503 - DNA, 542 bp, Ctenocephalides felis
cnttaatatactatgaatggtggagaagattgngctcangatgtgaaagagcaagaacaagttaacggtggcggtgaagaaggagccggcgatgcgtctcgtgaaaatggaagcgccgaagctcctggccgtgacgacgataggaaactctttgttggtggacttagttgggaaacaactgataaggaattgcgtgaacactttggtgcatatggagatatcgatagcattaatgttaaaactgaccccagtactggtcgatcacgaggatttgcattcatcgtgtattcatctcctgaatccattgataaagttgttgctgtatctgaacatataattaacaacaagaaagtagatccaaagaaagccaaggcccgccatggaaaaatttttgttggaggtttgacgactgaagtcagcgatgatgatattaaaaactatttcaatcagtttgggacgatcatagaagttgagatgccatttgacaagacgaagaatcaacggaaaggtttctgtttatacttttgaatctgagcaagttg

SEQ ID NO: 1504 - DNA, 542 bp, Ctenocephalides felis
cgcagtcaccctaacccttctagtcatatgcgttttctacacctctttcggagggatgagggccgtcgtctggacggacacgcttcagtccatcgtcacctgcggcgctatgttcgccgtcgtctggataggagtagcagacgtcggaggaatagcagaagtcttcaggagggctgacgaaggaggcaggatcatatttttcaatatgaatccaagtatttaccaacgaacatcattctggagtgtcagtcttggactgacaaccatgtggttgtctaatcttggtgtcagtcaaagttgtatacaaaggttcctgtctgtgccaactttaaaggacgctagatggtccattatctactttacgataggtttagtcttaacaaaatcaatatcctgcttcaccggactattgatgtatgctcattacaaagactgtgatcccttaagtactggtgatgtcaaaaaagcagatcagatgttgcctattatgtccacgacgtggcaggtatataccaggactataagtttattcgtactgngtc

SEQ ID NO: 1505 - DNA, 542 bp, Ctenocephalides felis
ctaataaagagatggctggaaaacgacgagttataatcgacgtagatgccggttcggacgatgccatagctttgctcatgctgatagcagcgcacaaacggggtgatgtggaactaatgggtatcacttgtgtggcgggtaatacaaatgtggataatgttgcgataaatgttctacgtgttctgggtgctgtaaaggctttagatatccccatttacaaaggtgcatcggaaggtctgattcctctagatattccaaattccacagaatctgagttccatggtggtgatggatttggtgatttagagcactatggaaatgatcctgatttgagtttaatcaaaccagagcatgcagtaaattacctaatttctgcagctaaacagtatgaaaatgaaattacttttatatttgtgggcctctgacaaatgcagcacttgcaattaaaatgtatccaggttttctagacaaaactaaggatgtgtantaatgggtggcaactataaagcgtgggtaataaaacaagaccgcagaattaattt

SEQ ID NO: 1506 - DNA, 542 bp, Ctenocephalides felis
aaaatactagttttattgccattaatatttgaaaaatatcattgagaaaatgtcaatattattatgcgcgctattttttgcttcgacgcttagcaatgaaactttgtcgaaacaccatcaagttaagaatcgtcgattttacatagattatgataaaaatacattcatgatggatgacaaaccatttcgatacatagcaggttcattacattattttcgggtacatccgcaacaatggaaagaccgtttggaaaagctaaaagcagcaggtttaaatgccgttgatacatatgttgagtggtcacttcacaattttgatgaaggaaaatattggtggggcagcaacgccgatttggagcaatttattaaaactgcacaagaagtaggattgtatgtaattttgagaccagggccatacatttgcgctgaacgtgattttggaggccaaccttattggctcttatccacccagaaaaagatattaaaccaaggacactgtttcgtatatggaagcagcacgagatggatacaagaatattaaa

SEQ ID NO: 1507 - DNA, 550 bp, Ctenocephalides felis
cttgaccgccaccgagtctgaagtggctgcactcaacaggaaggtgcaacaaattgaagaagatttggaaaaatctgaagaacgtgccggaagcgctaccaccaaattgcttgaagccacacaagctgccgatgaaaacaaccgtatgtgcaaagtattggagaacccgctcacaacaagatgaagagcgaatggaccaattgaccaaccaattgaaggaagcacgtctcttggctgaagatgctgatggtaaatctgatgaagtatcacgcaagttggccttcgttgaagatgaacttgaagtagctgaagaccgtgttaagggaggtgacagcaagatcatggagttggaagaagaattgaaggttgtaggaaactccttgaaatctttagaagtatccgaagaaaaggccaaccaaagagtagaagaattcaaacgccaattgaagactttgccgtcaaacacaaggaaccgaactcgtgccgagttcgccgaaaagaccgtcaagaactgaaaaggagtcgcaggctgaagacnattggcataaca

SEQ ID NO: 1508 - DNA, 548 bp, Ctenocephalides felis
aacatcccataataaaagcattgtacagcctagtggtaatgatcatattcgagggggtaatgttgctccacctagaatgcaagatgttgtccgtccaaaaagatattcttgtcaaagacctggtggtattgtaccagaaacaaacatgcaaggccaaccgcagcaacaacaacctgtatatcaacagaactactatgcaactgaatatactccgcctgtagcaaatgaacaaaataattcacatcaaggacaacatataccacaagcactaaatgggatgccccaaccagggggtcaggttgtacctcctaatatttctgtgccacccccgcaaacaatgccttatgtaccagaaccagttcctacacaggtcataaccactagtaatcaagtgatgccgcaacaagttcttgccctcaatatcctcaagttctatgcagtttaattcgggaggaccctacatggctcaaataatacttttatccacaatctttaggtatctgtcctctctaacatgcaccccacacaatatctcccaatccctcata

SEQ ID NO: 1509 - DNA, 405 bp, Ctenocephalides felis
gattattcaaaagaaagacaatttagaggattgcaaagtaaaattgaaggcgagcataaattttcagttattagacaaggagaagtgaaacagatatcggttggtgatattgtcgtcggcgatatttgtcaaatcaaatatggagatcttctaccagcggacggtttattgatccagagtaatgatctgaaggtggacgaatcctccctgacgggagagtccgaccatgtgaagaaaggcgagtccttcgacccgatggtcctgtcggggacgcacgtcatggagggcagcggcaaaatgctggtgacggccgtcggcgtcaactcgcaggccggcatcatcttcacactgctgggtgctgcagtcgaccaacaggaacaagagatcaaaaaaaaaaaaaaaaaa

SEQ ID NO: 1510 - DNA, 482 bp, Ctenocephalides felis
caagctgtcaaagtctggcaaatatattttaatttaataatttttgtctgttttaaataaaaaatgtttcggagagcgatttctagtgctactaaattgcacaaacaaactttaggtaatcaaattgtgcaagtcaggaaccatggtggaactgccaattaccgctgtgcttcacgtccttcaaaagaaattaaacttctcggtgaacttactggggctttaatgtggtactggtgcttgtaccatatttggactgaaccggatcatattttaggagagtttccttatcctgatcctagtaaatggacggatgaagagcttggtatcccagccgagtaatgatggatagttaattgatagaaataattaaatattgaaatttaatgaagtatctggattgtatatggtactgcaatttgtatatagaaagtgaataagatgtgttaaacggtagtgaaatggaaaaaaaaaaaaaaaaaaaa

SEQ ID NO: 1511 - DNA, 550 bp, Ctenocephalides felis
gctactcattttacgtaacgttttagaagtgtgtgggtgtggtgctaattttagcaccgtagcgatcgtttttattaagttttttttattttgagtaatagttttaatatattttaccaaaatgttgcatcttaagtcaatcaccaaaagtgcactgaaacataacccctccgaagtgtccacattggtcaaagctctgccaacggccatccaaacgcgctcttactccgagcaccaaattcccgataggctgaaggatgtcccaacacatcctaatccaagatttttcgacatggtggagtacttcttccaccgtgcctgccagatcgtcgaatctaaattggtcgaggacatgaaaggaagcaaaatgacagttgaagataaaactaagaaagtcaaaggtattcttatgttaatgcagccatgcgatcacattttggaaattgctttcccattgcgcagagattcaggaaactacgaaatgattcagggttaccgtgctcaacacagcacacatcgacaccaccaaaggaggttccgtttcaatggt

SEQ ID NO: 1512 - DNA, 550 bp, Ctenocephalides felis
gtcacttgtagcggtttgttcgattataatatttttacgaaacaatgaaagtaatattgagaaacaaataatacaaatgtagttgatttcgtacattttatagcaatcttcacgatggccgccggtccgatagcagaaagaaatcaagatgccactatttatgttggtggtttggacgataaagtctcagaaagtcttatgtgggagctatttgttcaatctgggcctgttgtgaatgtccatatgccaaaagatcgagtaactcaaatgcatcaaggatatggatttgttgaatttctgggagaagaagatgcagactatgcaatcaaaattatgaacatgataaaactttatggaaaaccaattagggtcaataaagcttcagcacatcagaaaaatcttgatgtcggtgccaatgtgtttataggaaatctagacacagaagttgatgaaaaattattgatgacacatttctgttttggagtaattcttcaaacccgaagatatgagggatccaacctgnaatcaaagggtttgcatcataaatttg

SEQ ID NO: 1513 - DNA, 550 bp, Ctenocephalides felis
ggcagttaacctaccgtgtggaataaattcgagggttttctgctgaagttgttattaagttaatgatatcaagtctatcacatatatttacgtactatttttaagtgtgacagaattataagtgtgctttgtttataatttaagaagtgaaaatagtaattaaagcagtaaaatatggtaaatttaggtgacattttcccaaattactgtttaaaaacatctattggtgatattaagtttcatgattacctacaagattcatggggaatattattttctcacccggccgattttaccccggtttgcaccaccgaattagccagggttgtaaaactgatgccagaatttgagaaacgcaatgtcaaggtaattgccttgtcttgcgatacagtagcttctcatctggaatggtccaaagatattttgagctatgcaggtgaaatgaccaagacattcccatacccaatcatcgacgatagttcccgcgaattagcagtaaacttcgtatgattgcccggcgagaaggataaggatggatgcgtgccgccag

SEQ ID NO: 1514 - DNA, 550 bp, Ctenocephalides felis
tcaaagtggacgttagttaaatgataattgatttgtagtaattgaaagttttgtattttattttgttaaaatattttgttaatttcgttgataataaattaataaaaagtgcccgaaaatgtctgcatctcctctggaacgattgtcaaaaacagagaccatcgagttgagggacaaacatattggaaaatcctgccaattgttcttccgagaggatcctctgaagattgtaagaggcgagggtcagtacatgtacgacgagactggcacaaagtacttggactgcatcaataatgtagcacatgttggtcactgccacccaaaagcagtagcagccggagcccgcaaatgtccctgctctacactaacaaccgtttcctccatgacgagctggtgatcctggcccgcaggatttcctctcttttgcagaacccctgagtgtctgctacctcgtcaattcaggatcggaggctaacgatttggccttgaggtggcaaggattcacacaggaaacaagatgttatcacgctgcacagtgagtagtagatgg

SEQ ID NO: 1515 - DNA, 550 bp, Ctenocephalides felis
agagaactagcctgtgaaaagatcgtcggctttggggcagccagcacgtaggtttctgactcatttcagtttggtcatttctgattggcatacatcattgttctgcaactgtttttataagtttttacacatcttccaaatcctgtgcagttttttttatttgggaccacagtatataacaagttattgtatgagtcagaaaaccgaaaaaccagtactatcaggtcagcgcatcaagaccagaaaaagagatgaaaaagagaagtatgatccaagtggattccgtgacgcagttatctcaggtctcgaacgtgctggcaacgatctcgacgcagttaacaaattccttgacacagcaggctctaagcttgattatcgcagatacggagaagcactgttcgatattcttatagctggtggattgtagtgccgggtggttcaatagcacaagatggagaaaagccccaaaccagtagttgtgtctcacagcttctgaggatatggagtcaatgcgaaaccaggagcaggtttcgtgaattatgctcgctta

SEQ ID NO: 1516 - DNA, 550 bp, Ctenocephalides felis
agaaagatattccantgaaaagtgctattctatggtttcaattantnttggatcacaaganatacctactcgttnatntaaaatgaaaattctaattttattcttaatcattctttctatgttttaccttgcntcctgtgatgagcgcatggtgaatggaaacgaagtatacattctaacattttattggcaattgtcctttncaagtaattttcaacatttttgcggtgcancaatgatcagtaagcgatgggcaataacaaccgctttttgtgctnaaaaaacgtctatccatgcagctagagtacgtgctggaaccagcaaatataatagnggtggtactcattacggtgtggaatggntcgtccctcatcctcgttatgatagccgcgatcaaaattcaatgtaggtttaattntgataacanaggatttcaatgaaactagaagaaccgcctgcnagctcgtanaggcaaatgtcgcttnctgtagctcctttgccattctggatggngatctgancgatccangagcacctatgtaagaaatct

SEQ ID NO: 1517 - DNA, 550 bp, Ctenocephalides felis
ttaatgtcgacggaacgcctttaacagtaaataaagaagtatttgcatcattggatgagcccgcaccaggagtagtacctactcctgaacctacacctgtaccgaaacccgagcaaaaatgtaaaaaagtaaaatttagttgcgtgaattcgtgcagttcacccgaaatgcagtattgtccggaaataggagcagatccggttaaggaatcctgtagcccagatcaagtgtgcgctgatcaaagtggatatctacagtgcaccactaaagaaagtacagtctgcaaagtacaaggtttcaaatgtccgtcaccatcgagattttatccaaatataaatgattgtcaaagctattattattgtgacgaaaatagtataggaacccaatattattgcccgcaaattttgcatatgatccgttacgtcataattgcggcctatggctctgggcacaaaatgctatacagttacatgtctgccagcctaaggtgcttccgtacattggtgataaatattgacgtcgatgtatggccggaagaggaccgtangca

SEQ ID NO: 1518 - DNA, 550 bp, Ctenocephalides felis
cgagtttatattttatttttaataatttaatttatattattgaatgggagattattagaattaattctataataattatttttagaatattatttgattgaatatctttaatatttataagatttgtattaataatttcttcaatagtagttaagtatagagaaagatatataatagaagattttaataaaaatcgatttttattattagtattaatatttgtattttctataataataataattattagtccaaatttaattagaattttattaggttgagatggattaggtttagtttcttattgtttagttatttattatcaaaatattaaatcttataatgctggtatattaactgttttaataaatcgaattggggatgtgctttattaattagaatttcttggataataaattatggtagttgaaattatttattttatataaaatatataataaataatttgaaataatttaattatatttttgatttaatttctgcaataactaaaagagcacaaatccttttcttcttggtaccagctgca

SEQ ID NO: 1519 - DNA, 550 bp, Ctenocephalides felis
ggtaaataaataaaaaaaatacttttatgataacagaaaaaaaactacaggtttaatgaaatcagttaaaatcagagtgaattttaacatataaatttaaatattataaaaatcatcttagcttttacaaacttaaattgcaatgagtaattgttgtcgaatattatggattgcgatagtgatcggtttaggtgtgttgtattacgaaataactaaagaatttccaaagccaaatatacctctggatacatggtggggaactggaaaatcacaaaaaattgatacatcaatgaggccgtttaaaattgccataaacgatgaggtccttaataccttgaaagtgaaactaagtgatgtgtcctttactccacctcttgagggcatcgatttccaatatggtttcaatacaaataccctgaaaaaacttgtagacttttggcgaactcaatacaattggcgcgaacgtgaagcattattgaataaattcccacttcaaaacaaatattcaaggcctggtattcactatgtccataaaccacagtctccaaaa

SEQ ID NO: 1520 - DNA, 550 bp, Ctenocephalides felis
ctggtcttcccgccttatcgtacatcataattcgaactcaaaatcccaatatcgtacaaagactagtcctcggcgctgctttgctatatttatcatttgttcacatgcacagacagtattatgattacggatcatacaccttagacattacaggtccccttatggtaattactcagaaggtgaccagtcttgcgttcagcattcacgacggcctggcacgcgacgagaaagatttaacgaaggaccagaattatcatgctgttcgcagaatacctactgctctagaattcttcagttacaccttccatttccagggtcttatggctggaccagttgttttttatagagattatattgattttattgatggaaaccatgttctgaaatttacaccgaaatcaacggcaagtctagataataactcaaacagcagaaaagttgtgcttgaaccttctctataatcattgcttcaaaaaagtgatagtcagcacaatatgcgcctgtatttattagttcttccattgttccaattaaagcttgaaagaagatg

SEQ ID NO: 1521 - DNA, 550 bp, Ctenocephalides felis
ggaaaacataaattcctcggatacaaaaccaactcattggatgaataaagatggaaaacctttgactattgaagtaggaaataaagatggatgggttattataaataaacagaattcaggttactatcgcgtgaactacgataaggacaactggaaaaagcttgcagatgtcttgaaaagtcctgaatttgaaaaaatccacgtactcaacagagcccaaattttagacgattctctaaacttggccaaaactggaaaacttgattatgaattggccttagacattttagattacttgcaccacgaattggattacgtggcttggaaagcagctgaagaagatctcaattttctcgataatatgctgagtggaacaaaagtctaccccaaatttaagaaatttgtattgcatttagtgaacaaagtttataataaaatgggatttgagcaacaagatgctatgggcacattgngtttcactcgcataaatgctctaacatgggcttgnaaatggccttncagatgcttgcagtctcatgtcgcttntgct

SEQ ID NO: 1522 - DNA, 172 bp, Ctenocephalides felis
caggatttcatggtcttcatgttttaattggaacttcttttcttattatttgtttactaccacttagattatttcattttaatcctaaacatcattttggatttgaagcagcagcttgatattgacattttgttgatgtagtatgattatttttatatatttctatttactg

SEQ ID NO: 1523 - DNA, 673 bp, Ctenocephalides felis
gttaattcccattaacacgcggcgtttttcgtttagcaattcaataaattacacacttcacaatggctgatatggaagatactcatttcgaaactggagactctggagcttcagcgacctatcccatgcaatgttctgcacttcgaaaaaatggttttgtaatgttaaaatcccgccccgtgtaaaattgtagaaatgtccacttccaaaactggtaaacatggtcatgctaaagttcacatggtcggaattgatattttcaacggcaagaaatatgaagatatatgcccatctactcacaacatggatgtcccacatgtaaaacgtgaagattatcagctcactgacattgatgacggttacttaacattgatggctgacaatggagaccttcgagaagatcttaaaattccagatggcgaattgggacagcaacttcgtaatgatttcgaatctggaaaggagcttttgtgcctgactaaaatcttgtggagaagaatgtgtcattgcgatcaaaaccacacagccttntaatatgattttcacacattcaaataaaatctatgagaccattcaactgttaacagttgcaagtggcgtgtatctagtgtgttgctataaatctgcctcagcttgttanattatgcaaaatcaggttagtctttgatatttg

SEQ ID NO: 1524 - DNA, 681 bp, Ctenocephalides felis
gaaactgttactcttttggttgcattaaaagttaggtatcgtgaaagaataactatactgcgaggaaatcatgagtcacgtcaaattacacaagtttatggtttttatgatgaatgtttacgaaaatatggaaatgcaaatgtttggaaattcttcacagacctatttgattatttaccacttaccgctttagttgatggacaaatattctgtttgcatggtggtttgagcccttcaattgatactttagatcatattagggctttagaccgtttgcaggaagttccacatgaaggtcctatgtgtgatcttttatggtcagatcctgatgaccggggtggttggggaatctcgccacgtggtgctggatacacttttggccaagatatttcagaaacatttaaccattcaaatggcttgacattagtatcaagagcacatcagctagttatggaaggctataattggtgtcatgatcgaatgttgtgacgatttctcggctcctaattattgctatcgtgtggcaccagcacattatggaattagatgatgcattaaaatttattctcaatttgaccactctaacgggtgaacctatgtctagaagactcnatactcttgagatatctatcatgtgtaattatcatccagntagtcttctttctacacgncataacnnct

SEQ ID NO: 1525 - DNA, 676 bp, Ctenocephalides felis
gccgntgaagccgcaccagctccagctgcagcccccgccgccagcgaacgccaatcatccaggggatcccgcaaagccgtcaagcgcagtggatctaacgttttctccatgttctcacaaaagcaggtagctgaattcaaagaagccttccaactaattgaccacgacaaagatggtattcattggaaagaacgatctccgtgccactttcgacgaattgggccgtttggtacaagagaaagaactcgacgacatgatcggtgaggcttcaggaccaatcaacttcacccaattgttgaccttgttcgccaaccgcatgtctggatcaggtggtactgatgatgatgatgttgtcatcaacgccttcaagaccttcgacaacgacggcaaaatcgacagtgacaggttacgtcatgccctcatgacctggggagataaattcactgccaagaagttgatgacgcctacgaccaaatggcattgacgataaaggcttcattgtacccagaagctcatcaaatgtgactgcgtgcgaagaagacaaaaagtggtgaatataagaaattgaatacttctacatatacatttaaacactgttacccattgtgggatatgttaaaatgaactacatattttgcaactataataaaagtatgaagatgacanacaaatatgn

SEQ ID NO: 1526 - DNA, 647 bp, Ctenocephalides felis
gagacatcgaaaaagtaagttttatagaacggccgcttacactttacacaaccaaaattaatctgctgaagaattttacgaagactaattagttttaaatctacagtatggatgtgttgaataggcccgctcacgaatttggaaatgatgaaacagttgaaactttatgggctatgaaagccatggatcatgttattgtctattttaatatactttgctctgtagacccaaaatttctcaaaatgtgcccccaagatgaaattatctaccattgttttcgtcaagaatttccagatatggatgttaaagtactagatgaaaattcattaaaaggctatacaggaaaatgccgatggagagaattttgtgaacgattcaaacatatagaagattacagttttggtccttaatacgcttagattgcacattggattatagtccagaaaatactattttagttccaagagttcagttttatgcctagaatctgtcgaaataaagaaggcttatgctgatcagaaaaaaatatgctaatgaagtgatgttgcgagnatgaaaatgaaatccatagaaatatagcatggtatgttaagagtcatgagaaaagggggtanttattttatttataatnttatcaaaaaaaaaaa

SEQ ID NO: 1527 - DNA, 540 bp, Ctenocephalides felis
gaggatgccaaaacagaaccgtgtcgcaatctacgagcacctctttaaggagggagttatggtggccaagaaggactaccatgcaccaaaacacccagaattagagcaaattccaaacttgcaagttattaaggctttgcagtcgttgaaatctagaggatatgttactgaacaatttgcatggaggcatttctactggtatctgacaaatgaaggtattgaatacttgaggacatacttgcacttgcccccagagatcgtgccctccactctcaaacgtcaaaccaggcccgaattggcaaggccaagaccagctgccggcccaaggactgaaggatctcgtccagctgaagacagatctgcctaccgtagggcacctggtgcacctggtggcgctgacaagaaggctgatgtcggtgctggcactggagacttggaattcgtggtggatatggacgtggcagacctgccctcaataaatttatataagtaatttataataaattcaataaaacatttatgataaaaaaaaaaaaaaaa

SEQ ID NO: 1528 - DNA, 671 bp, Ctenocephalides felis
catnaacagatatcccgatgatccaaagcatcaaaatgatttagcagtaacactacttatgggaaacagaccagctgaagctttacgcgttttgcacaaagttttacaagtttggagaaataatggttttgcattggtccactatggatttatttataaaactactatgaacgacttggaaagaggtgtaaaatatttgcaagaaggtattgacaccaaagataatggcacaatggatggaagattcttgtttcacctcggtgatggattgcaaagactgggcagaaatgatgaagctatgaaggtttatgaaaccggagtaaaaaataaaatcttcctatctcgatatcaacgttcactctataatattgatagattagtgtccagaccctggtggactattgaacaaactggttatactaaactttttaatacattaacttctaattggaaagctattcgagatgaagctttaaccgtgcttgcatgcaaaagcgcaagagtaaggaaaaattgcagaatcaaaatctgggcctgttagagccaggcagaaaattaagagatctgggnatggagcagttgacttatcggagnatangataccggttgtttacccatacagccgctatttgcntcaganctactgcctnggcaataatcactatgaccgn

SEQ ID NO: 1529 - DNA, 667 bp, Ctenocephalides felis
aggnnncacgcctatgctcaaaagaacttgcgcagatctgntcgtcgcattaaggaacttnccttccaagctgaagaagaccgcaagaaccacgaacgtatgcaagaccttgtagacaaattacaacaaaagatcaagacttacaagaggcagatcgaagaagccgaagaaatcgccgncctcaatcttgccaaattcgcaaggctcaacaagaattggaagaggctgaagaacgcgctgacttggctgaacaagccgtcagcaaattccgcgcgaagggacgtggtggatccatggcacgaggtggcagcccagtgcccgcaagaacagcagctcgcccacaatttgacggaatggctttcccgctaggttcgacttgaaccctgacagcgagttctaaattatttataattaattttaaaaaagcgaacgtggctgcttgacagtaaacattaatattttttaaaaattattaaaagtaaaaaatatcagctcgttcaattgtgcttagtatgacatttgatctaatctaacactgtcagnctaacacattatactatttatcgcccatacatcaacgtcgctgcataaaatatacagctccattagctcctaattcttanttttgnaatacttttttgcgatttatcaanggaattattatgtt

SEQ ID NO: 1530 - DNA, 670 bp, Ctenocephalides felis
agcgtgttcgccgaggaggaacgcgcacgttttgacacatttctttagtttttaagataaaatccaatccttcccaacaaaaaattagttttaagcgcacatttatgtttagtgacacgaaggcggttgttataaaattagtgtttacgtgatgtctaaacaacagtacacagttgacggtgatctattcggtacgcctcacaggaaaaaaccagtgccttggaatgagttcttgtacaacagcgaagagggaacagtcttaggaaggacaggactgagttgggcgaaaatcggtatattctacacaatattctacggagtattggcagcattagtggcaatatgcatgtgggtgttcttccagacgttagatcctcgtataccaaaatggcaattagacgaaagtatcataggaacgaatccaggccttggcttcaggcctttgccgccgatgagaacatagaaagcacgctcatctggtacaagggtaccgatttagacaactacagtcgatggncaaatcctttagagttcttcaatttacaaaactccggatacctcaccgagtaaacattcagtgtgctccactcgccgcccaaagttgggtngcgngacgcaagttggtcctgtcganaaacatttatatacagacngcgggtatttgagtgan

SEQ ID NO: 1531 - DNA, 558 bp, Ctenocephalides felis
aantngtcgaggtcacgaatctgaaaatgagtngncaccnattcagctgatctctgccacagcttaccagctcaaaaaacccaatcaacaaatgttgatcccaataactgnttggattggtatggagcaagcattcattggtgctgatttcacacaggcctatgtatcctgngcttttgggtattaagtcaaattggataccgtcatgatctgcttcggagtagtcaacgcaatttgntcagtcgtttttggttctataatgaaattcatcggtcgccaaattatcatcactttcggtttcttcctgcacatgggcctgatgattggattattattctggagaccaagccctgatgataaaatgatgttctttgtcatggctggactttggggagttggcgatgcagnttggcagacacaaatcaatggtctatacggaactctgtcaggcggacnaaagaggcagctttcttcaactaccgctgtgggaaagcttaaggttgtcatcgttacgctacagcacacacttgtgcccggcatgaanttacgtcaattgac

SEQ ID NO: 1532 - DNA, 660 bp, Ctenocephalides felis
gtaaaaacaaaataaaatcattttagtttgagttagaacatgtgttattataagttagcgtaacacacaaaaattaatcataaatgtctgataataattggtagtatacttgtacagtaaattctttattttccttttcccaatctttttctaaaagcgagtgtggtcatactgctgtggtaattcgtcaccgagaagcggatgaagtttatcctccatcattagtgaaggctttgcttgtcagaagagagaggagtgttggttgccggtgtttattgtagttttaatttaattttaaactaagttatgcgtatgacccaagacatggacgatgatgaaaagggaaagcttttcgtcggagggctatcatgggagactactcaggagaacctgcagaggttcttctcgaggtacggcgaagtgatcgattgcgtcgcatgaagaacagcgagtcggcaggtcgcgcggcttcggcttcgtcacatttgncgatccctcgaacgtcacgtcgtctgcagaatggccgactccctggcggaagacttagatcaaacctgcaccccgcccctcagaccaaacgggcgagctcccaagttcttgcggctgcatcacggnggaaccgctagtgtctcgcntacgaaagttgagtgctntgcnacg

SEQ ID NO: 1533 - DNA, 669 bp, Ctenocephalides felis
cacatattcaagttgattcaattcagcaaagattattacaaaaagttgatggtgtattagcagtacatgaatttcatgtgtggcagttagctggagatcgtatcattgcctctgctcacataaggtgtagaaatttatcagagtacatgaaaattgcagaaagagttaaggaattctttcataatgagggaattcattctactacaatacaaccagaatttgtagaactaagaagtttattagagccttcacgagatatggagcaaccatgtgctctagattgcccaattactgatgtaccatgtgctcaagctacttgttgtggaacttccaaaccagatagagataccccatcaccagcggcctcaccttttatgtgcaggcaacgaggagcaggtcaacgagttcaaggtggttcttcaggtccaaacactggtgatctagaaagtggtcattgttaggtggacatccaaccactcagttgttgcaattgcctctggtctaattgtgctgtccaaatcaaataaagaatcttgtgctgcacacattatagcgcaaagtccctgccatcagttgctgatattctatatgcaaattttnataagaatagatggaattatgcagggagganangtcatatgataattattatcattatgtggactggat

SEQ ID NO: 1534 - DNA, 546 bp, Ctenocephalides felis
cttgtnttctgaagcaataatcttgttaaatgctttgggttgtagcaaagatcctgatattttaaggagctacttggaaaaaactgtagaacctgattcgaaaatcagagatcaagataaattccgtgctatgtattctgtaatcagacaaggaagtgatggagtgacaattgcattagaatttatgcgtaataaattgccaaaaatgattgaacaatatacaagcttgaatgcgctcaaaaaagttttcgaaactgtaggcgcagcaatttcaaacgaaaaacaagaagaactgcttcgtgaaattattgctaaatacaattctacattttcggattccctaatgcaaggtgcaaaaactgctttagatgccatggaagataataaaacttggagagataaaaatttagctactgtgacaaggtggtttgaaaaacagcctgaagtttatcctaataatgcaacaaaactagtccaaagtatttattattacttgattgtattcaatattgattatatttaatatatacatcagtntcngaaaaa

SEQ ID NO: 1535 - DNA, 662 bp, Ctenocephalides felis
aagccgtggtagtttcgctgtatgaggaacctattcagcctcaacaagctgcttctgtcgtggagaaacttggtgactacctcataacttgcggctactaaatgtgaaacactggagtggccccttattaatttttaagaaaactataataattataattacgattaatgaataaatttaaacaatgaagaccggccagcaaaaagggacagaatttttttctcatgcctcctgcaatgcagtaaaatattttgtgccatttttgtgcctttgttcccggtgacctttttttcctcagaagggacacctggagtgtactggcaaaatcgaggacattagtttaaacatttgtattataaaaccgtgcggacggcaaaatgaataaaaaatcttactacgattaaatttgtattaatttcgatgtgaggttatcgacttgtggatttaaatatactttctcctttaataaaactcgtgcttttgcaatttatgatttgctattattagctattgatgnataaatctgtatgaattttgatccctcaataaagaatttatatagtgactagctctcagtttgaatttattatatcgtattgtgcaaagccgaccatagttgcgactgactcncgttctnttgtgctgacttgtattgctatnct

SEQ ID NO: 1536 - DNA, 668 bp, Ctenocephalides felis
gaaatatttacctacattagctttgccagatggatcccataattttacggaagattctgtattttttcatttaccaggattacaaaaggatgaacagactatttttggagtatcatgttatagacaattaccagtggagaaattagttaatataccttctgatgtaactcgcagcactgttcaaaaatcagtttgtgttctaagcaccttacctttatatggtcacattgagataaaacttgcattaatagcacatgcattttttgaacaaggcgacttcagccaaaccaagatattgcaggatgcatatcataatatgaaccaatgttttggctcaaatgaaattttagaaaaaataactataggattaagtgtcagagatttagtgttgaggtggcgtcataaaatattagttttatttaaattaatattattggaaaaaaaggttgcatatttggttcaccagtaaggccattatgtctagccctattaacttattatctcttcatccaatattatagacaaaggattattgagtcggcaatcaggacacttntataaaagaaaattctagtatatgcaatcagatatatcatgcggaaacagaattaatatctctgatctaatacaaatatgaatgtggaaagttttgagatatctaaatgctg

SEQ ID NO: 1537 - DNA, 620 bp, Ctenocephalides felis
atcaacttggattttgtcggttaattccgaaatcgaaaaagtttttaagtgcaaaacatttaactgtgacatcagtttgtaatgtatctgggaaggaaatgagatctgtaaatccgattgaaaggtttcctccttatgactataagaagaaaggatacggatttatcaatgcgttttttgattacacaactaagagattcaatgataacacaaaggttattacagtggaaggtccaccagctgttggcaaaactgcatttgctaaagctttggccgaagatttagatatgaaatactttccagctgttactatggatcactactatattaatgaatatgggtatgatctcagacaacttgatgataaattacctgaatcatgtaaaagcatcgattttgataaatttcataaagatccgcataatagaaatgtagcaacaatgcaaattgtgttatatatgaaaaaatatgaacaatatcttgcggctcttgccatttattaaatctggacaaggagttattttagagagacttgtactctgtttgttttctagaacctggctagctggttgttcgcaggactcgtcgatatttgaatagagcacacatccagatgagca

SEQ ID NO: 1538 - DNA, 557 bp, Ctenocephalides felis
gtcattcactttttacgagttctttagtgtcctaatttattaataagtatcagaatggtgccgaaaacaaaagtatttgttggaagcttgccgccaggctccaagcctgaagaattacgtcgtttgttcgaagcttacggtgttgtaacagaatgtgatattatgaatcgttgtggctttgtacatatgcagaccgaagagatggcttttagcgcgattcaagcgttgaataatactacatttaatggggccacgataagtgtcgaaaggggccgcatcaaggaacgcggatcaggtggtggtcgtggaggcggtggccgcggcggtcgaggatttggaggacgaggaggtggtatgaatcgtagtggtggaggacctgggggtatgcgtaatggtggtggccccatgggaggtggcatgcgtcgtggaggcggtggcccaggacccatgcgtggtggtggccgtgacatgaatcgtggacaccctattctngtgatggtggcgtggaggagatttggtggcgagggctggacccatgccaatggttgncgcgcgga

SEQ ID NO: 1539 - DNA, 556 bp, Ctenocephalides felis
gcgtgccttacctccgagctgttgttacttgttcattttcgccggtttgcgttcgaggaaattttgttttcggacgcacgtgagcggtaacgagtcctgcaaagatgtatataaaattctgtttattggcattcgtggcggctgaactaatgttaatgttagttgaggccaatgttattcctggtgaagaagaaaagagcgatggattcgagctgctcattctgcataacaacgacatgcacgctcggttcgagcaaacggcggcacgcagcggcccctgcgtagacggagaacgatgttatgggggcttcgcccgggttgcacatttagtacgggaagctcgcaagaatgaatctaacggcggccctcctgtgctgtacttgaacgctggcgatcatatcaaggaactccttggtacacgctttacaagtggaacatatcttatatgatgtaaacgaactcgctccagatgccatgtcgtgggaaatacgagttcgacacggtgtcccaggttgctccatttctggaaaatgtgaaatttcagtgtagctctacc

SEQ ID NO: 1540 - DNA, 620 bp, Ctenocephalides felis
cctacttacaaattaacgtacttcgacctcaaaggaataggagagcctttgagacttctactaagctatgggaacataaaattcgaagatgtccgagtgtcatttgaagaatggcctgcacttaaaccaaagatgccatttggtgtaatgccggtattggaggtcgacggaaaggaactgcaccagagtttggcactttcgcgctatttgggaaaacaattcgggctcgggggcaaaaatctaatggaggagttggaaattgactcaatagtcgataccctgaacgatttcagatataaattgacgatggcctattgggaacaagatgcggctgtaaaggagaaaaaaatgaaagaagtacacgatacactcatcccattttatacagaaaaacttgataaaatagcgaaggctaataatggcatttagctcttggaagactaacttgggccgctttgtttcgcggagttatcgaatatatgagtttcatatctggaacagatttccttggaaattgcaggattcaagagtgctttaatatgtgcaattgccgacgtgaaggaatggtcgcaagaggcaaaactgttgtatgtcatttgggaatttaaataacattatac

SEQ ID NO: 1541 - DNA, 620 bp, Ctenocephalides felis
atttgaatcctcttatcgattactaatcttttgtacagtttaatatttattatcaaggccttgtacgccagtgtgtgtaaaggtctcttcagtcgacgacagaggatagaagtcagaggacatttataatacgcagtttttaagttttttctggtgaatttgaatatatttgaagaaaatgaagaggtttttggttgctttggcggttttggtggtcgttgctgaggctaagctgtcatgttcgagtacaaaagcctcgatccccgaagaatggatcgacatgacagcccagtgcacgaggagcatgaggaaccagatccaagaagaactgagcgcttcgatgcaatacttggccatgggggcgcatttctcaagagacactgtcaacaggccaggatttgctgagatgttcttcaaatcggcaagcgaagagagggaacatgccatgaaactcatgtcttacttgatgatgagaggagaactgccgagaggctgcaggacttgacagaacaccactgtccaatcacacttggctgtggttgagtgctttgaagatctctgaatggagcttcgtccagaaataacatgtgacaaagcttgcagacatatggactatgata

SEQ ID NO: 1542 - DNA, 591 bp, Ctenocephalides felis
aagaagatcaagaagaagaaggcaaaagaagagtctggagatgccccagccgctgaagccgcaccagctccagctgcagcccccgccgccagcgaacgccaatcatccaggggatcccgcaaagccgtcaagcgcagcggatctaacgttttctccatgttctcacaaaagcaggtagctgaattcaaagaagccttccagctaattgaccacgacaaagatggtatcattggaaagaacgatcttcgtgccactttcgacgaattgggccgtttggtacaagagaaagaactcgacgacatgatcggtgaggcctcaggaccaatcaacttcacccaattgttgaccttgttcgccaaccgcatgtctggatcaggtggtactgatgatgatgatgttgtcatcaacgccttcaagaccttcgacaacgacggcaaaatcgacagtgacaggttacgtcatgccctcatgactggggagataaattcactgccaagaagtgtgacgctcgaccaatggtcatgccataagcttcattgtcccagaactatccaatgtgctgcgtgcgagaaacaanagngngatatagaa

SEQ ID NO: 1543 - DNA, 554 bp, Ctenocephalides felis
gcaactttgggtctcatggttttccaacagttgtctggaatcaatgctgtgatcttctacagcgtgtccatatttaaattagcaggaagtgacctggaccctgcggtgtcttcgatcatcatcgcagcagtgcaagtggtgatgagtctagctgctattggattggtagagaaatttggtcggaaaactttgctaatgatcagttccacggttatgggaatctgtttggcagctttggggtattacttcagggtgcaaacatcaggcgaagacgtcacctctctgggctggcttcctctgtctagcctggttttgttcatcgtggctttttgcatagcctatgggcccattccctggatggtcatgggtgagattttctctgcgacgttaaaggagctgcttgcagcctaacagtcatcgcagctggtccctcgtctttctggtcactaaagtattccccacatgagggagactttaggaggagatgtaccttttggatcttcactttcatgatatcgtacactgtttcgtgtcttctggtgccgaacaaagat

SEQ ID NO: 1544 - DNA, 604 bp, Ctenocephalides felis
aagattacctagacttggaacaagaattcgacctaataaatctaaacagcaaggtaataaggaatctacggaagtgcaatctcaagttgatgctgataaagtaggcgaacaaccagcagagaatgtggttgagcaaagtgccgaaacaaaagctattgccgaagaagatgatgttaaggatgcatggggatgctgattcaagcagtgaagaggaaagcacaactgaaacaccagcagtaactgcaaagtctgaaacaaaagtggatcaatctgcagaaagtaaaaaggaagaaacttcttcagaagaagagtctgaagaagaaagtgattctgagtcagaatctgaaagtagcgaagacagtgataatagaactgatgcagaaaagaaacgagaaaaggctctccagagaatacaaaaacgcagaattgatgcagaacagaataaatcattagacaaactgagagctgcggtggttgtgtgttgggacatgtagatctggaaaacaaaaattttgcaatactcnacaaatgtcaagatggtgaantgtggtttctcaccaaatgtgctcaaatgtcatagaaacataaggacagtaaattgtaa

SEQ ID NO: 1545 - DNA, 608 bp, Ctenocephalides felis
gccntttttcgatcaattcgtattagactttttgataaaaaatgctgtctaaagcttcgcttttggccaaggtatcccggccactgactgtggcagtgcgaacaacatcccaggctgcaacatgccctgctcctacaaaggtagaagaagccgatagtgctgaaagagatttggtcaacttcccaaggccaacacgtttggaacattcacctaaagttcgctttggattcattccagactcatggtttgaatttttctatgagaagaccggtgttactggaccttacatgtttggaactggtttaattacttacttatgttcaaaggaaatttacgttatggagcatgaattctatactggtatttcattgggtattatctgtctctatgccactaaaaagttgggtccacatattgcaaaatacttggacaaagaagttgatgcctatgccgatgaatggaattcaggtcgtgtagaagaagttaaaagttaccaagatgccattgaaggagaaaagttggacaatggagactgaaggcaacttatgttgatggatgcaaacgtgaaatgtgcttgcacttgaacactacaggaccgcctgaaggta

SEQ ID NO: 1546 - DNA, 595 bp, Ctenocephalides felis
agacntacgagcaccaagtggacaagacacacagtggacaaacagtgaaattgttgatttgattgtatcagtgatagccagtgatataacaatattgtgttaaaaaatgatgacgccgaccgaaattagcaatttgaaaaaagtgaagttggagaatttttgggacgaggtcgatcccaaaaacatatcgcctgagtatccaaaaaatgaaatccaggattttttcagcggcggaagcgtcttcataaccggcggtaccggatttttgggaaaattattgatagaaaaaatactgaggacatgtcccgatttgtcaagaatctacatcttggtccgagacaaaaaagggaaagatgcaaaaaatagattaaaagatatgttaaatgatgtggtattccagcgattaaagaaagagagtccgtggcccaacaaaaattggaggttgttatggagatgttggcaagcccgatttagggttgcggaagtgatagaaaaatatacaggatatgcaacagttatattcacgtacancctgcaatttcacgaccataaaaactcagttgcataatgtaagggcantagagtgttgaactgc

SEQ ID NO: 1547 - DNA, 595 bp, Ctenocephalides felis
atcntatcggtgtgtttatatccagaagctccgncaacttgttacaattgaaacaagtatggatcatgtcggtgttccaattcatcaacgttttggtgcttctattccaagttttgtatgggtacattcctaatatctggattgtttttgccatcgttttatgggaaggacttctaggaggtggtgcttatgtcaacaccttctacaggatgagccatgagattccaatggaaaaacagaagttctctatgtcaattactgctattgctgatagtctgggaatagccttggctggatggatagctatgccaacacataatgccttgtgtgctttgcctaaaccaacttaagtgaataaaatttgaccaaatccaactttaggtggatgaaattaaagtttagttgtttgcgagtgcaagtgtagataattgaaccagtgaaatagtttttaacgtaaaatttctatcagaaaattatcattttaaggaacattgtggataataaaaccttagcttaaattaaatacccacttataaactaatatcgagtattctctattaaatcaatcgaaccgtcatgtgaatcgaatatttga

SEQ ID NO: 1548 - DNA, 653 bp, Ctenocephalides felis
gaanncaatagaagacctctagtaatggggtcagttggaccttatggagcacatctgcacgacgggtcagaatacagtggctcttatgcaaaaacgatcacgaaagaggaaatccaagaatggcatagaccaagaatagaagctttaataaacgcaggtgtagacggattagcaattgaaactattccatgtcagttggaagctgaagccctagttgaactaatagttaatgagtatcccggcacaaaagcatggcttagttttcaatgtcaggatgaatctcgtctcgcccacggcgagttattccgcgacgcggccttgagctgctgggagctggcaagggagtcccaatgtttactcgctgttggggtcaattgcgttcatcccaaatacgccgtcggtctctgcaaatccctcaatagggatcagatgccccaaataccgtcgtgttatcccacagtggcgaaaattacacccgccgaagggtggaaagataagaccgtgtgttctgtccaagatacgtcagttctggttggatcaggacccttttanggaggatgtgcgtctgtgcaggcatagaatntagaaattggatcgtggatataacggattaataatttaataaataattnttacgaatttntataatgtgg

SEQ ID NO: 1549 - DNA, 553 bp, Ctenocephalides felis
ctcgttcactgcatttatcagcaatggctcagattaaggtaggcgataaaattccgtcggtagacttatttgaagacactccagctaacaaagtgaatattgcaaatctcgctgcaggaaaaaaagttgtcttattcgctgttcctggcgccttcactccaggatgttctaagactcatgtacctggctatgttgcaaaggctgaagaattaaaaaagagtggaattgctgaaattctttgcgtctctgttaatgatccttttgttatgagtgcttggggtaaggatcagcagagcaatggaaaggtaagaatgcttgcagatccaagtggtacattcacaaaagaacttggattgggagttgaattgcgcccttaggaggtttacgttctaagagatctctatggtgatagacaatggtgtcgtatcagaattgaatgtagaaccagatggtctggactttcctgttccttagctgacaaacttaaagtttagaatatagtaattattgaaataagagtaataaatataatgtaatattaaaaaaaaaaaaa

SEQ ID NO: 1550 - DNA, 661 bp, Ctenocephalides felis
gaacntcgtgctgatagcgcgcgcgttccgtcaccaattcataattccggacttccaaggattcgcgaaggacttggaggaagtgtactggaagtgcaagggcaataacgatggcaaggtgggcagaccgtcgcgcgttgtgaacccggacgacgatcccgccggcgaaaatgttgctagctacattccacagcttggctcgcatgaaccctgatttttggggtgtgagcgtctgcaccattgacggacaaaggttgtcgattggagattgcaatgtgccatttactttacaatcttgcagtaaaccgttgacatatgccatagcattggaaaagctaggccaggcgacggttcatcaatatgtcggtcaagaaccaagtggtagaaactttaatgaactcgtactagattataataaaagaccgcataatcctatgataaacgctggagcgatattggttgtcgtattgaaaacttagtcaaacctgagatgactctactgagaagttcgactatatgaccacatatttaagagattggtggtggaagagtctcggctcaacaaccggtgtcttgcggacccgaagccgcgatagaatacctttggtttactgaggaaccagtctnccggtaaactaatacggatctgcttatttatgtg

SEQ ID NO: 1551 - DNA, 671 bp, Ctenocephalides felis
gcattattagctaacgatcttcataatatatttgtcaacagtaatctaacgcatttgagaaaacttcacttggaacaaaatgaaatattaaattttggagacaaaagagttttctgcgatttacctagtctgcgagatttgcatttgggtgataattatttatcagagatagactttaactttttgtgtcttaagaatttacggtttcttgatttggaacggaataaaatcgaatacttcaagaagcgtgacctgctcaccctggaccaggtgaatgctgctggccgagaagagcagttggtcatcgatgttggcggcaaccctttccgatgtgattgcattgttagcgagttttattcatggctgttccgaactaatgttaccgtcaggaacaaggagtctttacggtgtcatcgcgcccaaaagcatggcggggaagcattgatcagcctatccgtcgataaatgtcgaaaagctcaatctgtagtgcacgatcgagtaaaatatctaccgtgactttatgctgattattttaatagtcatttttctggactgtcgcgtctggctacatgagcagagataagttgaaatagcattactctgtgatagaaccgtttaaaaagtcaattnccgatccgaacatgacagaagttatataggaattgtgcaat

SEQ ID NO: 1552 - DNA, 611 bp, Ctenocephalides felis
cacntttaccatcgtcgaaagttgaagtcaccgtncagaagttaaaggatgatcagaaactgaagagtcagcaggagagtgcggagaatgtttccacggttacggctctcaaacctgcagatagtgccgagataacagttgtgaagaaaacgctgaaacagaaaataatacatgaacttctacattactaccatggttttcgacttcttttcatcgatttaaatgtatccagaaaattaatatggcgagttctgaatggaaaccagttgaccaggagggaacatagattgctagtgagaaccactgctgatcttttcagacttctgccattttctgtgttcattattgtgccttttatggaattactgctgcagttgccattaaactattcccaggaatgttgcatcgaccttcaaactgcccagagagagaggataaattgaaacaaagtttgaaggtaaaactagagatggctaaatttctgacggaaacattagacgacatgactctacacacaaagatcacagatcagaattggctaaagagttcaattgggttacgaaatgagacagctgcctcagcnntacgaagaatcatgaaattcaaaatgt

SEQ ID NO: 1553 - DNA, 566 bp, Ctenocephalides felis
ctgntngacaagaattgattgacagatttaatgangatgaagaaatttttatatttttattatctacaagagcaggtgggctaggaattaatttaactgcagctgatactgtgattatacatgatattgactttaatccatacaatgataaacaagccgaagacagatgccacagaatgggccaaaagcggccagtaactatttatagattaattagtaaaggaactattgaagagggtatgcttcaagttgctagagaaaaacttaatttggagagagaagtcaccactaacacggagaatgatcctcaagaagtaaaaaatgttgtgcgattactcacactagcgctgggcgtcgattcaaataaagctgccaatcttttaactccatcgcgagaaaatcggaatcctaattgcaaaagccgctattatttagcacacattatgaattttgatcttttaaatttattagttaattgatgattatttaaaaatataggtatttttatataatttatgaattactgcagcgccaataaaatccgtttactctaaaaaaaaaaaaaa

SEQ ID NO: 1554 - DNA, 585 bp, Ctenocephalides felis
acttnnctccatgcaagcctctcttgaagccgaagccaagggcaaggctgaggctttacgcatgaagaagaagttggaagccgacatcaacgagcttgaaattgctctggaccatgctaacaaggctaacgccgaggcccagaagaacatcaagcgttaccaacaacaacttaaggatgtacaaaccgccttgaggaagaacaacgtgcacgtgatgatgcccgtgaacaacttggcatttctgaacgccgtgccaatgctctccaaaacgaattggaagaatcccgtaccttattggagcaagccgacagaggccgccgccaagccgaacaagaattgggagatgctcacgagcaattgaacgaactttccgcacaaaacgcttcagtatctgctgcaagaggaaattggaatccgaattgcaaaccttgcattctgacttggacgaactctcaatgaagccaagactcagaagaaaaagcaagaaggcatggttgacgcagctaggttggtgtgaactccgcctgacaagacntgcccaaacccaagagaactcagaaaggtcttgaacacaaataagaattg

SEQ ID NO: 1555 - DNA, 612 bp, Ctenocephalides felis
agacngctgtttttgtgttcaaaaagcagtaaantatagaaaaaaaaaacttattactagtgcacattaacaaaaataagcagaacaactattaaaaatatgttttccatgtcaaaccttttctaaaaaccattcaatgcatagaaatgtaatttttaaaatcaatagtatgattttttaaaatatttggttttataccaggagtggactactgaatttctgcagtgttgctatggctctcaatgatctagggtacaaagctgttggtatacgaatagactctggtgatttagcatatctctcagttctggccagagaaacatttgagaggatagcagagaaatacaacattccttggtttgcaagactcatgataattgcatcaaatgatatcaatgaagacacaatactcagtctcaatgaacagggacacaaaatagattgttttggaattgggacgcatttagttacatgtcaaaggcaccagcacttgttgtgtctacaaaatggtagaaataaatggacacctcgaataaactcagccagatgtgctaagtacatgccagtcgnagatgcctatcgttatatggnagatggcatgccctatgctgc

SEQ ID NO: 1556 - DNA, 613 bp, Ctenocephalides felis
gtggttcaaagataatccaagatgggtaagggaaataatatgatccctaatgggcacttccacaaagattggcaacgttttgtgaaaacttggtttaaccagcccgcaaggaaaattcgaagacgtcaaaacaggattaaaaaagctcgtgccttgttccctcgtcctgctgctgggcccctcagaccaattgtgcattgccccacagtgcgataccacactaaggttcgagctggcagaggttttaccctcgaagaaatcaggggagcaggtttgaatgcaggatttgctcgctcgattggcattgcattagatgttagacgtcgtaataaatctgtagaatctttacaacagaatatacaaagattaaaggaatacagatctaaattgatcttgttcccaagaggtggaaagaaattgcataagggtgaagcaactgaagaggaatgcaaggttgcatctcaattagaaggcgtcgtgatgccaattaaacaaacttcagttaaatctaaagtcgtgtcattctgaagatgaaaagaaattctagctttcccacttaagaaaggtcgtctgtcagcgctggtggtttcgtgaaaaggagtaaagatcantg

SEQ ID NO: 1557 - DNA, 659 bp, Ctenocephalides felis
aatnntattctgaatactatgttcgattttagcgttttcccggcgagcttgatataatattaattgtttggagtaaaaacaacaaattttcgaggattaatttatacaaaaaataattaaaatgaaattagttaggtttcttatgaaattatcacacgaaacagtgtcgatagaattgaaaaatggaactcaagtaaatggaacaataactggcgtggatgttgccatgaatacgcatttgaaagctgtcaaaatgactattaaagatcgagatccagtatttcttgatactataagtttgagagggaataatattaggtactatattctcccagatagtttaccattggagacccttttgatagatgatacacccaaagccaaagctagaaagaaggaagcagctcgaggtggaatacgaggaaggggtcgtggtcgtggtggcccagaggcggtcgtggaggtggtaggggacgtggacgaagataataatatttttgattgtaagctattataatcattgaacattggctcataggaaggctatcaatttgatgtataatgtatttgatcaacaagaatttangttgatccatttttaaccaattttnttgtggctaatcagtttgagtcgatcatattctgatgttatatgaaga

SEQ ID NO: 1558 - DNA, 564 bp, Ctenocephalides felis
gtactttgctttcatttttttcattattttcaagagcaatggctgaagcacgcgaaagaactttcattatggtgaaacccgatggcgtccaaaggggtttggtaggaaaaatcatcaaacgattcgaaagctaaagggattcaaacttgtagcaatgaaattcatgtggccatcagaggagctcttgaagaaacactatgccgatntttcttgccagaccttntttncttggactagttaaatacatgagctctggccctgttgtccccatggtctgggaaggcactaatgttgnaaaaactggtccgtgttatgttaggagctacaaatccagctgactcgaccccaggaaccatccgaggagatctctgtgtggaagttgccgcaatattctccatggatcagatggtgtagaaagtgccaagaaggaaattgcttatggtcactgaaaaggaagtaatctctgaccccagctcatgaatcatggtttatgaataatggtgataatttngattttgnntaanctgattaaaaaaantatgtgaataaaaaaanaaaaaaaaa

SEQ ID NO: 1559 - DNA, 617 bp, Ctenocephalides felis
gtggntttcataggatgctcttggggtttccccagtgggtccaccaatgtaaataatcgaatcgttggaggcaaagacaccacaattcaagaacatccttaccaagtatcaattttgtacaatgatgaatatcacagctgtggaggttctttgatttctgaaaaatgggttttgacagccgggcattgcatcgattctttcaaattctacatccgtgtgggaagttctcttgaaggcgaaggtggagctgtgcatcgagctctaaaacaatatcgacatgaaaagtttgatgcaaaaactgtagattatgattatggattaattgagttagacacaccggtacaacttagtgaaaatgtaaaattagtcaaattggctgaacctggtgttgaacttgaagaaggaactctactaaatgtcacgggatggggtagccgcgatccagcgcactctcaaatagtaactgaccatatgtatcccaagaagttgcaaaaatacattcagacaggtgatctcccatatatgttctgtntggtaaatgcanganngaagactgcatggnacttggtggcngtgatcaatggatccattggatggttctgagcttgtggcctacc

SEQ ID NO: 1560 - DNA, 659 bp, Ctenocephalides felis
cttanatgtgtggaatttgtgactgtgatcctgcacactttggaagacattgcgaatgttctgctacagatgtaacatcacacttagatttggcgatgggatgtagaagggataataccaccacagttgattgctcaggaaaaggaacttgtgtatgtggtgtttgtgaatgcgaacagcgtgccaatatcgaagaacaaatctccggcaaatattgcgaatgcgataacttctcctgcgaccgtcataatggtattttatgctctggtccagaacatggtgtttgtgtctgcggtcagtgcgactgtctgcccggctggaccggccctgcttgcgattgtagagataccaatgctacatgtatcgctccaggatccacaggcgaagaaatgtgctctggacacggagtttgtgaatgcggagtttgcaagtgtgatgttgctgaggatggcagatattcaggaagatctgcgagaagtgtcctacttgtcagccgtgcaggagttcaaagaatgtgttatgtgtcaaatgtataaaactggccctcacagaagagaatgcggaaattgacatctccatcgtcaagatnagtgaactgtgaagtaagatacattatgtctctccacgaaacatgccattnatctttntcacaaaagcaa

SEQ ID NO: 1561 - DNA, 662 bp, Ctenocephalides felis
cggaanctttaaaaaatgagtgctcctacagtaacaattgcccagggcactttatcaggaaaggttctggttaatgaaaatggaaaagagtaccatggtttttgtggaattccatatgctgctgctccagttggcaaattacgtttcaggcctccacaaaaaccagaatcatggagtggtgttcgtcaagccactgaacaaggcagtgaatgttcatcgaaacatatgcttttgcaacaccctataggaaccgaagattgtctctttgcaaatgtctatattccccaaactgatgccaaaaagcctcttcctgtcatgttttgggttcatggaggaggttttgtcatgggatcaggaaatactgacatgtatggtcctgattatctcatggactacgatgttatcctggcaccttcaactatcgtctcggagttctgggatttttgaatttagatttggaagaatgtctggaaatgtcggactaatggatcaggttgctgctctcaaatggcaaaacaaaacattgcaagtttggtggtgatcaaacacattctattttggagaatctgtgtggtgcagctacattattagttgctgatctacagaggttgtccaaaagcatgncaagtgaggcttaaatcatgcttcacgcncactaagan

SEQ ID NO: 1562 - DNA, 655 bp, Ctenocephalides felis
gaatntgctactttacaagccgctattgaagcaatcagttcaatgaacatgtttgacctaggaggccaatttttaagagtgggacgtgctataacgccgccgaacgctcttatgggaccgacaactggatctatgatgccgactgctgctgctgttgccgcagctgccgccacagctaaaattcaagcgatggatgcagttgctagtaatgctgtcgctttggggctgccgagtttgagttcttcacctacaattccgttatcagtgccgacgatagcggtgccgcccatcgcaacgataacgccatcagctcccgttgctatatccggtgctgttaagttaccaggtgtcgtcataccgcgcaggtgtcgtcgtacctcaagtcatacagcctccaggaattgtgacgccgacatcgcaaccagttataattccagtatcagtattacctaattgtgaatcttctccgacgatgatatcaacaagctcacctgcacacagccgatcacaatactacacagaacaatgaagccagaatggccaagaacncacaagagacttnaaaaaactatagatgaactgacccaacttacagacaagaacatgtgctaaggnaaagnnncgcctatntcaagntatgaagangatcactnta

SEQ ID NO: 1563 - DNA, 651 bp, Ctenocephalides felis
ctnttcagataattctttttcaccaaaaaataatatctgtaatttacctcgttaataatggctgcttcagcaattccctttattattttcaccgtcctttggggtatagtgggtgtcgttttaccttttatagtgccaaaaggaccaaacagggggattgtgcaagtcgttttgatattgacagcagcttgttgctggctcttctggctctgctgctacatggcccaaatgaaccccctaataggacccaaactacaccagaacacgattttattgatggcaagagaatggggaaatccaatcagcgatttgtaatttagtcaaccaacattcctgaatatcttctgatataaaatttcatactgtgtgatgatgataaatgaagataatatgatttacatttcacataaatgtgtacatataattttaagaacaagttattaatttgcgtgattgtatatagatattttatgagaactattcgttgtagcaaatatatgtgtcctgggagaaaaatnnnnnnnnnnnnnnntnnttnntntnnntnnnntggggggggccggccccatcccntaaggggggtttaaatancggcgggtttnnccggggatgggaaacctggttnccaatantgcttganantcccnttnc

SEQ ID NO: 1564 - DNA, 664 bp, Ctenocephalides felis
cgaataggtccgttttaaattttataaattaaaaaatatatcaaaatgaaaagttttgttccctgtgatccaggatgtgattttcccattcaaaatttaccatacggcgtattttcgacaccggcaaatcctgtgcacagaattggagttgccattggagctctcgtattagatttgagtggagtattgcattttttcaaaccagaatatcagaatgcgcttagtgccacaactctcaacccattgatgggcctagaaaaatctgattggaaacaaattagggagaccatacaaaaattgctgttggaaggttcggaacttcacagaaatgaagaactccaacaaaaagtattgcttccacaagcgtcatgcatcatgcacttaccagctactattggagactataccgatttctattctagcatacatcatgccaccaatgttggaacaatgtttaggggaaaagataatgctttaatgcccaactggaaatatttncggtggatatcacggtcgcgcaagctcagttgtgctctggactgtatccgaagaccatgggacaactttacagtgtggactgacccatttggccttnagnctatgatttgactgaagnganttttgagtgcaagcacaaatggtcaagagcngtgcaatctanann

SEQ ID NO: 1565 - DNA, 664 bp, Ctenocephalides felis
gtantttttacggccacttcagcttcacccattaaaaatgaagatttggtttggatggaaagcggaaagttcgaaggtgacatggtcttaaatcaggaacaaatgttatcagttttaggacttgggtctaaaaatggccttatcgacaaaaaatatcgctggcccaaaaacgaagtgccttacgttattgtaggaggatacttcaatcgaagtcaaattaattacattcataaggctgttgcagaatttagaaacatttcttgcgttaaagttagacccaaaacagttacggacacaaaatatgttcaaatcacgggtcttccaggcggttgttattctagtgtcggattccaagatggagtccagacccttaatttagcaccatacgaaattgagaaagggtgcttccgtaaagcgactattcagcacgaatttctgcacgctttagggtctatcaccagcaatcgactcacgacagggacgaatacgtgaccatcatgtgggacaatattttgcaaacactgaccacttaacaaatatacggtagtccgtcaggattcgaaccggtatgctattggcgtatgcntacgggcttcggtctcgaaacgngaagacttcgcacaagancacgtgnagatncatggcaaggtgagatatgantcat

SEQ ID NO: 1566 - DNA, 662 bp, Ctenocephalides felis
atttttgccaaacacgatcaatctcaagctattntcaacagacacaaggatgttttagccagatggcagcgtctcctgggagactcccgtgctcgcaagacccgtttgctggacatgcaagaacagttcagacagatcgaggaattatatttgacattcgcaaagaaggcatcagctttcaattcctggttcgagaatgccgaagaagatctcacagatcctgtcaggtgcaactcgattgaggaaatccgtgccctgagggaggctcatgcacagttccaggcttctttgtcgtctgcacaggctgattttgaagccctggcagcccttgatcgccaaatcaagacgttcaatgttggccgaatccttacacctggttcaccatggaggctctcgaagacacctggaggaacttgcagaagataattgctgaacgtgatactgaacttgctaaagaagctcaacgacaagacgaaaatgataaattgaggaaagagtttgcaggacccatgctttcataatggtgccgagactagaactcaatgatggaaggtccggtttntcgacagaattggagnccttcnagaaggtacaaagttcngccaaagagtgttgagcgaatgaaaatggtntnctggagacttnttgnacaattcnacttc

SEQ ID NO: 1567 - DNA, 648 bp, Ctenocephalides felis
atttttttcatagttatgcatcctttatcattaggattaatactaattatccaaacaatttgaacaagaatatttattggtttaatttcaaaaacattctgattntcatatattttatttatttcatttattggaggaatattaattctatttatttatataacaagaattccaaatactgaatatttttctttaaatattnataaaactatttttattattttattattaacattaagaattattatttattataataaaaattttctattaatttttaacaataattccatatttaatgattttaattcaaacttacttatatataattttaatctaaataaattatataattttccaaataatttattaactattatattaattatttatttattaatttcattaatttgngaggtaaaattcagatattttttatggcctttacgaaaaaattttaaaaaaaaaaaaaaaaaaaaatcgngggggggccgggcccaatcgcctaaggggtcggttcaatcctgggcgggttacacgcggctgggaacccgggttnccacttatcggctgggncatcccttngcagtgggtatagcgaaggcccccgcnccttcaaagtgccgctgatggaagnaatggagcgtn

SEQ ID NO: 1568 - DNA, 661 bp, Ctenocephalides felis
caggnttccacaacttgtcattaatatctcggtctcttcactgagacggtaaaagaatttcaaaatgggttacttttattgtatatcacttttatgcctgttcactatagttagctgtaataccggattagatcctaaaggtccaaaagttactcatgaggtatactttgacatcagcattggtggtgaacctgcaggcccgtgttttgatcggccttttcgggggcactgtacccaaaacagttgaaaatttcgtagaattgtccaagaaacctaaaggtgaaggatacaaaggcagtaaattccacagggtcatcaaggacttcatgattcaaggtggtgacttcaccaggggagatggaactggaggccgtcaatttatggagaacgttttgctgatgaaaactttaagttgaagcattatggtgctggatggttgccatggcaaatgctggcaaagacctatggatctnaatttttatcctacaaaccctgctggtagatgacgtccgttgattcggaaagtatcaaggaatggatgtgngaggaaatgatcacatcacagattcaaaacaaccccactgtgtgaatttagacttgngtnactgttntaacctcgggggtaagaatcactaataaagattntctttgtatttttatn

SEQ ID NO: 1569 - DNA, 941 bp, Ctenocephalides felis
gtcntttgcgttgaaagctgaaacatttctatttttatctcgaattgcacaagcatttatttagtaactttaattagtgtacagtattagcaaacaaaatatgatgaacattcaaaaaattgttaggagcttaaaccgaggtggagttgcaagaatgtcaactggacagtacggtgatggtgctggcaaaggaggtggtggtggtggatccatccgtgaagcaggtggatctttcggcagaatggaagctgctagagaagaagaattcttttataaacagcaacaagcccaattgaagaaacttaaggaacaagcaatagatcagaaaactttccatgaggaacaattaaaacttcacaaggaggctttggagagacatgaaaaacatttggctgagcttaagaagtaaattgaagtttcatatatagcattatgaaaatgttagacagtgatnaaaattcaaatatttgntctattactgaattaataaacttgcattaagcttctataagttattagttttctagcatcttaatatactcattgncactacatatagttttaaattcattggngctatgcatgtattggactaaatattggaaataatccataacaatttttttgngaaaaaaaaaaaaaaaaaactcggnggggggggcccggaccccaattcnccctntaggggngtcnattacnaatcactgggccgcggttttacaacgtnngngactgggnaaaccctgggggtancccaacttantcccttggaaaacantccccttttnncaagtnggggtaaaaccnaaaaggcccnncccattnccctttccaacaatttgcccccctgaantggggaatggcaattngaacctttttttttttgtaaaattccgttaanttttgtaaaancntnttttttaaccanangcccnaaangg

SEQ ID NO: 1570 - DNA, 931 bp, Ctenocephalides felis
aagatttagacctagacgatgtaatcctcataggaaagacacaaacacaatacattttaataatttacatcgaaaaagtaagttttatagaacggccgcttacactttacacaaccaaaattaatctgctgaagaattttacgaagactaattagttttaaatctacagtatggatgtgttgaataggcccgctcacgaatttggaaatgatgaaacagttgaaactttatgggctatgaaagccatggatcatgttattgtctattttaatgtacatttattaaaatatttatcttcaacttataggcaatattcagtacagacgtgccttatttcagatactttgctctgtagacccaaaatttctcaaaatgtgcccccaagatgaaattatctaccattgttttcgtcaagaatttccagatatggatgttaaagtctagatgaaaattcattaaaaggctatacaggaaaatgccgatggagagaattttgtgaacgattcaaacatatagaagattcagttttggtccttaatacgcttagattgcacattggattatagtccagaaaatactattttagttncaagagtcagtttatgccatagaatctgctcgaaataaagaaggccttaatgactgnatcagaaaaaaatatgctaatgtaagtgatgtgcgagtaatgaaaatgtaaatccatagaaaataattagcatgggtatggttaaaaagtncatgaaaaaaaagnggggttttatntttttttntntttaataaangattttttcaaaaaaaaaaannnnnnnnnnnnnnccttgggggggggcccgggcccaattccccctntanggngnggntttnnaaatcactgggcggggttttnaacggngggaangggaaaaccctggggtacccaattaatncctgn

SEQ ID NO: 1571 - DNA, 942 bp, Ctenocephalides felis
ttttaaaaaaaatgacgcgtataatacatacgtcagccgttttattattagcattattttacctctcgagttgcaataatgcagaggctacagaaaaacaaataccgatgacgaaaatcagtcaaaacctnggcggaccgacaatgaagttcctttactgttattcctgtggttacaggaaagtctttgaagactacatcggcatcatccaacaaaagtaccccgaaatcaggatagacggtgccaactacgaccccccaggcctgtacatgtacctagcaaagttcctaagtctagccaaaatggctttaatcatctgcgtcttgaccagagtcaatctattccgctacctcggcttagaagagcccacgtggtggacctggtgcctcgagaacaaaatgtactcctgcatgatgttcttcttcttggcaaacacgatagagggacagctggtgtcttcaggtgcgtttgagatttctttaaacgatgtccggttggtcccaagttggaaacgggaagaataccttnacccccagagttgttcagattatagataatcatatgaatatggttggctgntaaagtcgantttaaaccggagttttgngaaatgaataattatgggttaataacaccgtttgntattttgaatttttgggtaaaccaaacnaaatngnaattttttctagggttggtttccattccanggattntaaattaaaacctgnnaccttcnntantatatatatttgaagangngnttgatgnagaaattatttnattacctttaatggatatttaanaaaaaangggggtataaattttantttttntttgggaaaancnanatannanantntttatngnggggggggncccgnccccatttncctnaggnngcnatttaaatttatnggcnnngnnttaaacctgggngtnggg

SEQ ID NO: 1572 - DNA, 918 bp, Ctenocephalides felis
atgtnttcgggcatttagtgttttgaagtatcgtggcataaagcagatttaagttaatctgcttcattcaatacacaacatggtagggaaacccaacaagatgtatgtttttaagcgagatggccgcaaggaagaaattcattttgataaaatcacttcaaggattcaaaagctatgttacggattgaacatggattttgtagaccctgtctcaataacattaaaagtcataaatggattatatactggagttacaactcaagaacttgataatctggccgcagaaactgctgctaccatgacaacaaatcatgctgattatgccgttcttgcagcacgaatagctgtttcaaacttgcacaaagaaacaaagaaacaattttcagatgtcatggatgatttgtcaatatgactaatgagtatactaaaaagagatcaccaatgatagcagattatcatcataaaataataatggataatgcagatcgcattaactctgctattatttatgatagagaattcagntacaattactttgggttcagacattggagcgtcttatttantaaaaattatgggaaaagtagttggacnaccccacatatgctaatgcggtagctntttggaatcattggggaaaacnntggtgcngcaattgatccctttacttantttctggaaaaaattttactcatgccnagccacattttttgttgtnccccnccnanctcaattatnaagtggnttttcttgctttccanaanaangttttgangggttttgntctttaaaccaagnggntttttattcnaaaatggggggngggtttggngacccctttttggttttngggaaaaaccttctttgggggacccaagggatttttaagggnttngtcnttcnccggtttnaaanaan

SEQ ID NO: 1573 - DNA, 922 bp, Ctenocephalides felis
ttatttgtgaaataaatttattataaaatgttagatctatttacaatatttagtaaagggggcatagtgctctggtgctttcagagcactagccacatatttgcaccatctgtaaatgcacttattagaagtgtcatattgcaggagcgatctggaaaaaatacctacgaccacgattccttaacattgcaatataaattagacaatgaatttgagctggtgtttgtggttgcctttcagaaaattttgcaactgtcatacgttgataaatttttaaatgatgtacatttagagtttagagataagtataagaatgacttacaaaataaaaggtattttcaagaatttgactttggtgcttgttataacagtattctgcgggcggctgaagaatggggtcggactcaggctaagttacctaaacaaatgcgttcttttgaagattctatgaaatctaaaaagacagttgcttcaatgattgaaagaaagggcgagggaaaaaaagaccccagaagaatggtaaacaaaaangcaaaaatggttggtttgatgaagaaaaaattaatacttaaactggtattggacccgngccaaccaataattccaaaagnggtgatccaatgattaatcatgccaaatcgatgggaacttgcncaaaaaatgggggcctnttaaaaaaaaaaaaaaaacttgngggggggcccggncccaattcccctntagggaggcgantacaaataactggccgcggtttanacgcgggaatgggaaaacctggngttncccanntaatngcttggaganattcccttttncaagtggggtaaaaacaaaaggccccaccnatgccctttcnaaaattggccncntgaangggaaaggnaaaatntaacggtaanttttttaaaaatccggtnaantt

SEQ ID NO: 1574 - DNA, 943 bp, Ctenocephalides felis
attgtntgttatttagtttttaatgtcatcgcaaaatgatgattcaacgcggtctgccgctgcaaacaatgtggagcctaatgaaacagatgggttgtcttcagagcgcccagaacaaggtcaatctgagagtagtatatcaaacttgatgaaacattttgctaacaaattaggtttaaatgaaaaagatgaaagtgatgaagatgaaccacaggttttatcagaagttacaattgagggtgtggttgaatatattaaaagtggaaaatgtaaaaatataataacaatggttggagcaggaatttctacgtcagccggtataccagattttcgatcaccaaactctggcctttatgataatttacaaaagtataacctgcctgatccacaagctatttttgatattgattactttagtgaaaatcccaagccatttttttccttagcaaaagagttataccctggtaattttcggcctacaatttgccattattttattaaactattgaatgaaaagaaattggtattaagacattatactcagaatatagatactttggagagagtatctggattagatgaagataaatggtagangctcatggttcatctacaaatcacatgtatcggtgnaggaaagaatatnccctgggtggatgaaaaaaaaatnttttntgatgagaattccacttgnacatgccggagaaagtggtcaagcctggatataccgtctttggngaaaatttgccanaaaggttcattggctaataaaanaagacttcacccaaagngccttggtnaanaatcatggganccgctttggtggtcaaacctttgcttccttggatggantgggattcggaacntggcctaaacttttgattaaattaaaaaaaanggggggaanggggntaaaaggttccaatggtaggtttnttaaang

SEQ ID NO: 1575 - DNA, 931 bp, Ctenocephalides felis
ccgacgttctaagcacggtcggggacatgtgaaccctgtaagatgcacaaattgtgctcgatgtgtccctaaagacaaggctatcaagaagttcgtcattaggaacatcgtcgaagcagctgctgtacgtgatatcacggaggcttctgtttattccgcttacgtcttacctaagttgtacgctaagttacactactgcgtttcctgcgctattcactctaaggtagttcgcaatcgctctaaggaagatcgtcgcattaggactccaccagtgagatcattcccaagagataatcaaaggcaacaaaatgctccaagaaagtaaatgttcatattttaaataaaaaaaacgacaacttaaaaaaaaaaaaaaaaaaaaaaaaaaaanncctngggggggggcccggccccaattcnccctatagngagtcgtnttacaattcactggccgccgttttacaacgtcgggactgggaaaaccctggcgttacccaacttaatcgccttgnagcacatcccntttcgccagntggcgtatagcgaaaaggnccgcccgatcgcccttccaacagttgcncagccttgaatggngaatggcaaattggaagcgttatatttngtnaaaaatcncgtnaaattttgtnaaacaacttntttttttaaccaatnggccngaantcgggaaaatccttttaaatnaaaanaaaaanccggatagggttggggttnttccctttnggaanaaanttccntttttaaanaacgggggnctccacctnaaaggggnaaaaccttttttanggngaangcccctcgggnaccntncccctaatnaattttttngggncnggggcccnaaanccttaaatggnancctaangggnccccctttaaaatttgcngggnaaacccgcaaccggngaaaaaagga

SEQ ID NO: 1576 - DNA, 907 bp, Ctenocephalides felis
attgnttaaattaaactgttgtcatttaagctttaaattacacactgacaacggagaagtacagtttatttcgcaatcgttatgttaacgttttctcttacatgtatgaaagttatttagttataattaaaaatggctctgcaaagcttgaaaggtttttctaaattgttaaacaaatgttcgaatcgtgtttcatatttaactgtaagatgtgcatctcaatattatgacatagatgataacatatttggattaaatgaggatcaggttcagttgaggaagaccattttcgattttgcccagaaagaattagcacctaaagcagctgaaattgataaaaataatacctttaaagaactgagagagttctggagaaaattaggagacttgggaacattaggaataactgctccagcagaatacggtggaacagaaggcacatatttagatcatgttattattatggaagaattatcaagagcttcgggagctattgccctctcatatggagctcattctaatctagcaataaatcaaattcgaaggaatggaactgatgagcaaaaagcgaaatatttgnctaactttggtctggtgaacatatcgggctctagcatgtctgacctggtctggacagactagttctntgaactaagagcngagaggaaggngattttttgtttcaagggaataatttgggatactaaggnccaannctgaacttaanggttatgccctnccatccaatgtaaagcctcacatggaattccgcntttttgganaaaaaggtttganggattaatnctggccaaaattggttaacttggaanggaggtcaattccngtgacctgntttcaaaactgaaggtncnccccnaantttttngngaaaaggnaangggttttt

SEQ ID NO: 1577 - DNA, 917 bp, Ctenocephalides felis
tttattgcatcaggcgacaaccatcttttcatagtgacagagttcatggaaaacggttccttgagaagctttctacacaaaaatagaaacagattgaccaaaaccgatcttttagacttctccaaacaggttgcaagtggtatgaagtttttggaagagcgtatgtatgtccatcgagatttggctgccaggaatattctggtggacaagaaattcggtgccaagatttgcgattttgggctcagcaggattataaaggacgatatgtacaaatcgactggttcagcatttgctgtcaagtgggctgctcccgaatctatagagtataggaattttacgtccaaatcggacgtttggagttttggaattgttttgtatgaaatctatacgctgggcaaggaaccttacccggaattgcagaagaacggcgaacttatagacatgctgagaaatggttccggatgcggaaaccggaattggccggagttgaaatttacgaactcatgaccgatgttgggaattcgccaagaatccagcccgacttttgccgaagtctacgaactgatcaacgaagttacgaaagtcgattatccgaagccgaagtcgtcgaagaactaaattaatgaatagttgcnagttttggccatntcttacctntaaaaactaattattttttattttagtttggaaaaaaaaaaaaaaaaaaactnnngggggggcccgnacccaattccnccttanggggccgtnntncattccctggccggtgnttnaaacgtcgggnttgggnaaaacctggngttcccaacttantcgcttggagaaatcccnttttgncanttngggtanaaacnaaaaggccccnccgtcccttcccaaatttggccnctnaatgggnaangcaaattgtaccttnt

SEQ ID NO: 1578 - DNA, 939 bp, Ctenocephalides felis
ttttaacgctcttataaaagaaattgttaaatctattgaaatccttattcatcggtgcctattttcggcttaaagatggttcaaaagaagcctaagaagaaggtcggaaagaaagtggcagccgcccctttggctgtgaagaagtctgaacccaaaaagttggttaatcctttgttcgagaagaggacaaggaactttggaatcggtcaggatatccagccaaccagagacttatccagatgcgtgagatggcccaaatacatcagaatccaacgccaaaagagcgttttgcagaagcgtttgaaggtccctccaccaatcaaccagttcacgcagactttggacaaacaaacagctacacagttgttcaagattttagaaaagtacaggccggagactgctattgctaaaaaggcacgtttgcaagcacgtgctgaagctaaagcccaagggaaggaagacacacctacaaaacgtccaaatgttgtacgttctggcacaaacactgtcacaaaacttgttgaacaaaagaaggccacttgttgtgattgcccatgatgtggacccccttgagttggtgttgttcatgccagccctatgccgcaaaatgggtggtccctactgcatagtgaaaggcaaggttcgtcttggagcctggtccgcaggaagacatgcncatgtgtagcactaaccaatgttgacctggcgacaggagtgggtttgaataagttggttgaggccgcaagaccacttcaccgatnggcccgatgagatcaaaaggcnttggggcggnggnggtntgggatctaaaacccttgccanaattgccaagttgganaaaatcaaggcccgggaaatggcncaaaaaccgggttgatnaatattgattgganaaataaagnttttttggtggnaaaannnnnnnnnnnnnnnnnnncn

SEQ ID NO: 1579 - DNA, 919 bp, Ctenocephalides felis
atntttattgcatttgttgcgctcttcactctgcccaaagtttatgaaactaacaaaacacaaatcgatgccaatctcgatgtcgttcgaagcaagttacaagaaattacttccaaggtaaaagcagctgtaccaattggaaagaaagctgaaagtgataaagataaataagcacaaaaaattatatttatataataatgtggatatttaattgtatagcgatatacataactcttcaaacataaccacaccctttttaacaataattaaatcaactaaatatgaaatatatattatatatgttcgattgtttggacatatcgaaagctatatgtgaatattgcaaatcgaattgatttgtagtatatatggaatcaattttttttcatgatgaaccaattcgatagatttatagaaagcctttttattttaaatatttacatttgacactaaaaataggtatcttataaaaaaatttcatttaatacatataatatgtctcatatataatatttattatacattcttttaaagaaatatgttaaaggtttgnaaaatattactttttagtattaggttctattcaaaaattggttgggtggaattatttttggnattggcggtaaattttatttttaaataatatgcaattctcatccttgnctttaagaataatnttttaaatatggattggtnaaaagtaangtatgaattttacttntcgcatcaatncaggtatcattaaatttnttttaggagtttaaaaaanaaaangcncnngnnnnngnnnnnngnntnncctggggggggggcccggncccaattnccctnagngggggnggttaananncnggccgggtttnnaacgggggnngggnaaaccnggnttccccaattaanngctgtggaaaaaccccct

SEQ ID NO: 1580 - DNA, 935 bp, Ctenocephalides felis
ctttnctagttattaagataacatnattaaaannacttattaacaataatgtcngctaatttaaaaaccatatacgcttttgcgcgagagatgcattccaaaaatataaataaacctatacaatatggtacagctggatttcggaccaaagctacagacttggactatgtcatgtttcgtatgggggttcttgcagctcttcgttcccgtgttaaaagcacagcagtaattggattaatgataactgcatcacataatcctgaagaagataatggtataaaactcgtagacccccatggtgagatgcttgaacaaagttgggaagagttagcaaccactttagttaacgttagtgattctgagttagaggctacagttgaaaaaattgtaaaagacttgaatatcgatcttaatttgaaggctaatgtgtttattggtatggatacaangtatagtacgtncccagtctttgcaaagctgctgttgatggagtattatctatttcgggggatctcccagagaattttggtattggtaccgactcccaatgcttcactattttgttttntntgcaaacctgatcaagcctattgggaaaacctactggaagaangnttttatacccaattggataacttgcttcaanaaccccttcgggcgangttncatttcaatgggaaagnattncnccaaaattttnntttgatnggngccnatggantggggggcaaaaaangnttcaatttnaaaaagacnggnggangtttgatttgttttttaacaancggcnaaggaaaataaatnttaggngnggggctntttttggaangacaccattcncnccccaaggantncnnttaaaaaanttttcanngngntttttgttgaaacccaancgnatgnttccnnttnngganaaaaaaaggttttantgc

SEQ ID NO: 1581 - DNA, 920 bp, Ctenocephalides felis
tttnatagtgatgcatcctttatcattaggagntaatactaattatccaaacaatttgaacaagaatatttattggtttaatttcaaaaacattttgattttcatatattttatttatttcatttattggaggaatattaattctatttatttatataacaagaatttcaaatactgaatatttttctttaaatatttataaaactatttttattattttattattaacattaagaattattatttattataataaaaattttctattaatttttaacaataattccatatttaatgattttaattcaaacttacttatatataattttaatctaaataaattatataattttccaaataatttattaactattatattaattatttatttattaatttcattaatttgtgtagttaaaattacagatattttttatggtcctttacgaaaaaatttttaaaaaaaaaaaaaaaaaaaactcgagggggggccccggncccaatcgccctatagtgagtcgtattacaatccctggccgncggtttacacggccgngactgggaaaaccctggcgttacccaacctaatccgccttgncagcacatcccctttcgcagctggcgtaatagcgaanaaggcccgcnccgtcgnccttccnacaagttggcgccaccggaanggggaanggcaaatgnnagcgttnatnttttggtaaaatccggggtaaaatttgntaaaancgnccatttttaaccaatnggccggaatngggaaacccttnntaatncaaagnattgnccgggntggggtggggngtggtcngttnggaacaaagtcccttttaaggaacggggncccccgnnaagggcaaaaaccngttttaggggggnggcccctccggnaccccccctaanaggtn

SEQ ID NO: 1582 - DNA, 904 bp, Ctenocephalides felis
acagatacgtagctgttaaatgtcattgcgttgctatttttgattatttcatcagtatttcaataaatccaacatatgtctcggcacacatcattataattaaattattagtttcatttccattaatttattttactggcgtcaatatgacggtatcaaacgacgaattagttgaatcttttaaagctttaggtttaagtgaacaaaaggcgaaagaaacgttaaaaaatacagttgttacgaaaaatttaacattagcattacatgaggtgaggggcattattttgccccaaggagctggttctttaatctattatgtggcaacaaaaatcaaaccacagattatagatcaattgcctgtacttgtaaaatatatatcaacatcaaaattagacacaacagttagagttgatgcggccttgcaatttatgttgtctcatttaaatggatatcaaatcgatgaatttgagaaggcttgtggaattggtgttgttgtacacctgaacaaattgaaaaagcagtaaatgaggctatgttggaacataaagaggcaattcttgagaaacgatacagatacaacactggtcctttgatgcaaagtgtaagagttctttaccctgggcagatggtcggctataaatgtgaagtggacttacaggttttgacttattggggnccaaaactggtgccgattancaccttggcaaaagtggaaagaaagtnaagntcacnccagtgcggataaaaatcngaccgaaaagaagcccgaggaagtggatcaagcagcttggggccatgtntttntgaatgatgaaaaaaaagnccttttatgcctctgggnaacctttaaaacngggggatgagtacccccctcccatgactttnaaaaacntttnaanaaang

SEQ ID NO: 1583 - DNA, 907 bp, Ctenocephalides felis
gggantgttaaatcgccgtaggtgctcgcatagacaaatagttcctttttataatatattgtaatgaaacatttctcactcaaaataaaaatactaagtattgctgcgtaaaaatattttataagggcggtcaaactagtctctcataatttgatttatctcagaagccaattatttcgtatatgatttggcgccaattccattccccagaccgcccgtcaaggaatacgtcagtgcacatttgctgtgtcgtatttgttgtttacttgtgttgtgtccggataaataaagtgcttgtgatttaagtaaaatggctttaaatgatgataatgaggaaaatatagaaaaaagtcataaagatttgtgtttagaattaaatatggacacgtctgcagctactgcttcgtgggattcttacaattctattagagaaaattgtcattagagggaaacccgaagcactggttatgttgctcattatatgtagcctgtcgacaagatatgactcccacagtgggtcaagtgaggccttagtagaaggaaattgtgtcagtttaactagattattgagattgtgcaatattagtctggggtgagtttttaaaaaagtaagacatgggctgaattgacaaatatgcctgaatcattatgagacgtttagatggattagaaaaagttngctgggctgngatttattcaaaagttcaagcttattcgaccactggttgngaaacccacaagaaggttgaggatcaccagtctcccaacnaacaaaaatttaaatctntcacaagatatcccagtctgtgggtcttttggtgcatnaaaggaaacnccctnccaaagngangattaattgcctggccctctttgntgggccggcttgattggtatatcnaaagccntg

SEQ ID NO: 1584 - DNA, 898 bp, Ctenocephalides felis
gttttntnctagactgatatatgcaaaaagtgtaaaaaaatatagatgaaatgcgagagcgtgattttgcagacatgtgctgaacagtatactattgtgtttagatctagaaagtattgcgataagccaatgttactaaaaaggcaatttctttattttgaatattatcttatcgagtaggtaataacaaaataatcaacaaacgtgaattaatgaagtgataaaaaatactgacaataatagtggctcaaacggagatgcttagaagttctgtgaaaaatatgtgatcgttaatttgtgcatggacaaattttctatcaaaatgaagactaaagatatggaaatgaatttagaggaactgaaaaatgataacatcaagaaacagcaggatgaaatcaatttttcatttcgaagtattcgttatacaagatgcgacagaaaagaaaaaaaatcagtgtgcatactgaaaggagtctcgggatgctttacatcaggaaaactcgtggccatactaggtccatcaggtgcagggaaatcttctctgctcaatatactatcggggntcagagaaacaggccgtgcaaggntcaatccgtctcaatggagccaatgtgacattagataaacgggtttaggaaagcctgttggtatatacccaagatcngcatgctggccactaccaccgagagaactntctgttgcagcagactgaaatgaaacagaaatcgggtaaaactgtggagatgcatgcaaaatgcttacttaccaatgttanaccncgattantgcnttttggnggcaaaaaaanatttcaatggngtcaatggggaaaatccccaatntgttttggtgancccttnggccttgaagggttcgcctttnactaaggccctntttn

SEQ ID NO: 1585 - DNA, 912 bp, Ctenocephalides felis
tgatttagatgtcggcgaactgtttagcgtcaacattgtacaattacagtaaatattgtttaaaacctaatctactatcggccggaaagtcccatttaatattgactcttaatttttctactacaatgtacagaaaaggaaaatttgactttcctaagagatttacaggacaagaaaaaagtgtatgggttgagtatatagaattagctatcaaatataagccattaaatttgggacaaggttttcctgattatccttgtccagaacatgttataaaggctttggcagatgttgcaactggacccgattcattattgcatcaatatacaaggggttttggacacccaagattagtaaatgcattagccactttatatagtaaagtcttgaatagatcaattgatcctatgaaagaaatattagttacttcgggtgcttatgaagcactttactcaacaattcaaggacatatcgatagaggagatgaagctataattatagaacctttcttcgattgctatgagccaatggtaaaaggagctgaaggtgtttgcagatacattgcattaaaaccatcttctgataaatgctctgatgctcaaagttctgctggattgggttcttgataaaaaagaattggaatcattattcaatggaaaaaaccaagcttattattttnaataccctcacacccaacaggaangtattcccttggaagaacttgaatttatgntgactatgtaaaaaaggatgtctttgttatcggtgaagttatgaatggatggngttaagctcatgacctataaaatggtaccttccggatgggggaaaaactttactntggactgccgnaaaactttntggtcagggtggaantgggngggcctttggncctttggattactaaaaaaa

SEQ ID NO: 1586 - DNA, 941 bp, Ctenocephalides felis
antcgggcgcggccgcggtcgcgggcgtggccgaggcagaggaagaggtcgcggccgaggttcctcaactcctgagtacaccgtgtcctccacaccacccggtggaggaacgattccttgagtgtggccttaccaatctccatatcacaccggcgaacatcatggtcaaacagactctccaatgggaccttcttgcagcgttagtaatccggaagctggctgctcgtgctcgcaccagtgccatcaaccagatgacgtggatgatactgtttggttttaagctggtgtatatggatattggttaggtattgaaatcttgattcttatgtgaactcgagtttatttaattagaatattatattgtaatcgcattttataggctgtggagataaacttcttgaataatatattaaatattgcccacatttgctcataatttgtaggagtcaataacgcaacagaatgacttttgaataatatattagtcattgacatgagccggtgttttaaaaatgcttagtataatgggtaaattcttaatagtgaataaaaatattagaaaaaattggtttctggatgtgattcaattggatatattactattgaataggtaaacaatgaaccttattggatcaatgtgcgatatataaaatacacgttgttggaaatattcatctatctcttgataaactaacttttttgctcacttcttcgtacctnaaaatcttggggngattttttaaaggnaagttttgngctntatggatttttaaacttgacttaaaaaaaaanaagtcnaaatggtttcctaatattcaccgnnccannaaanatagttctaattattgngttancatttttttttaacttggaggcgtatnttggggntngggntnaanannttggaaattnattttnaaacttttagttttaaaanantn

SEQ ID NO: 1587 - DNA, 925 bp, Ctenocephalides felis
tgtgacagcactcaaacatgtgttttgtcaatactccatcatcaaatatcaaggctataattggaagctttttcccggaatcgtttgctggcacgggaaatgcgcataaaatgtatcccatgagtgaacactttttcacacttttggaagaaatgggttatttgcatctacaagctaccaaaccagatacagtgggcgttgctttaagagattcaccagctggtttagcagcttatattttggagaaattttcaacatggactaacagatcttggaggtcagttaaagatggaaacttgctgttaaaatacaatattcctgaacttttagacaatgtcatgatatactacgttactgattccattactacttcaatgagattatatgcagaatcattcacaaaagcacaccttgctttgaacttagatagggtgcgcaatcatgtcccagcagcctgcgcaaaatttccaaacgagttggcttatgtgacccgattgccaacttgctgagaaatataaaactttattgcagtccaatgacatgccaagtggtggccatttttgcagcatttgaggaacctggtctttaacagaagacattttcactgcggtgaaaaagtttaaaagaattttattccaaaaaagctgaagaaagccaaaagaaagctgatttgggataattttggtggtggatatataattatgctaataatatttggagataaatttaacccattcatggtcacatatnttttttccttcctccctttttttaaataaaaaaaaaaaaaactngngggggggcccgncccaattcnccttntgngagtcgattacaatnactggccgngttttanacggtnggactgggaaaaccctggggtanccacttaatggcttggnaanaatnccctttggcngtgggg

SEQ ID NO: 1588 - DNA, 892 bp, Ctenocephalides felis
tatattcggatataatttctatgttttatcaaatatattgttaaaaatgttatagtgttattgtaaataattagtcattaataaaaaatggctacatatgaagaatttattcaacaaaatgaagatcgagacgggattaggcttacatggaacgtttggccttctagtaggatagaagccactagattagtagtcccgctagcatgtctttaccagcctttgaaagagaggcctgatttaccaccaattcaatatgatcctgtacaatgtacgagaaatacatgccgagcaattttaaatcctttatgccaagttgactatagagccaaattatgggtttgcaacttctgctttcagaggaatccgtttcctccacaatatgctgcaatttctgagcagcatcaaccagcagagttgattgcaagtttctctacaatagagtacaccatcacaagggcaccatgtatgcctccaatattttatatgtcatgggatacatgcatggatgatgaagaactgggtgctttaaaagctctttacaatgtctttaagttatggccccaaatctcttggtgggctagtacattnggaaaatggtcaggtcacgagtaggactgangtgtcaaagacttgtttagaggcctaagattaacagctaancaatcaagaaagttaggcattgtcggaagtgatncccaacacagaaaggcccaatgcccacaataagcgggccagccaatanatcatccacctttccataaangcaaatggntttaccggccttttggganaacggnaccagaaccttggcctgtncctnaagggaagggggcttacgttaactgggnctgatttttcgaagcccgngggccttttgngngctttttgnccn

SEQ ID NO: 1589 - DNA, 928 bp, Ctenocephalides felis
tattcgttttacaaatcagtctcaaacgataaacacaaagtgaacgttttaaaacaaacataaaactgtgcctaatcccattcagtgatcgaaaaaactatataaaaccagttcgatagtaataatacataatttacccagcaacgtgcactgtataacctacaaatcacgatttcgactgaatgaaattatggacgctgaagatttgaatcagttctacaacgggcgggagatgggtgcttggcctcccaatgttggcatccttgccatcgaactgacgtttccgtcgcaatatgtcgaccaggccgaactcgaggcattcgatggagtgtcagcaggaaaatacacaattggactcggccaagcaagaatgggcttctgtggtgaccgagaagatattaattcattgtgtttaacagttgttaaaaatttgatggaaagacatcaagtgccttatgatagaataggttatttgggagtaggcacagaaacccttctcgacaaatcaaaaagtgtaaaatctgtccttatgcaattattcgaacccactgcaaangtgtactgatatcgagggtgtagatctacaaatgcttgttatgggggcactgctgcctttcaatgctgnttcctgggtcgaaagcagtgcttgggatggcagaatggctttgggttgttgctggaaacattgcagtatacccaanggngctgctcgtccaacaggaggngcaagtgcttgaaccatgctggtgggtcccggacttccnttgcgatgggacaaaggcttanggctttatgtntganacatgcttattgatttttccaacctggattgggttcaaagnttccccggtgganggnaaaataagttttaatgntntttngggagcnctggacccttggtttgctnttactgggaaaaaagggcaag

SEQ ID NO: 1590 - DNA, 922 bp, Ctenocephalides felis
tggtggcagcagggaaattcaactgactctcgacggagaaccgggggtcaagtataacggagtctcggactgggtttacgaagaggaaatgctgggttctggcgatgcactttggttttctccggacggtgcatatatcgcgatcggctgctttgacgactccaacgtcgacgaaatgatgtatttccgttacggagagtctggtactattgaaagccaatatccggaattggtagatctgcgatatccaaagcccggtagagtaaatccgacagccaaagtaaaagttctccgtctgaacgaagctcgtggtcgtaatatgccctggacggaactgacagctcccgaacaggatgttggcaaagatcatctgctagccgctgtcacctgggcctctaataacgaggtggcagtcacctgctaaacagacgccaaaactattctgttatgcaaatctgcaatgcagggaccggagaatgtaaaacggaactagaaaccagcatgcctggttggatcgacgtacgtaaattctggtttactcctgatggcgatcgttatataactatcagatctgtgcaacacacttgatggattacatatcctcatatagtaggagcccgaaagaaggacggaaccgaaaccaatccccagtgggaaatcgtctggtaccaatattataggttcgatgccgaacggggatcttttntnttactcagcaacattggctggaaacngtccccccaagaaattttggtngnccggttccaaagcttgtccttgnccgtcacttntgacccaaaatgganataatgcngatttggtaaagngatttaacnaanagttntttttgcttgcttgattggcttggaccaacccnccctttgcgtnctttttgaccggggaagatnaaancttgcaacng

SEQ ID NO: 1591 - DNA, 926 bp, Ctenocephalides felis
ctatttaaaattttgatatgcaatttgtgttaaatgcgttgtaaagaaaactatttatacctatttactgttgtctttattttgcttcatattgtatttttcggtatccataaatatcgttgtttgtgaaaatttgtgtgaaaaagtctattaagcatcttcaagtttggtatggctaaacctcacctgaagaaagtagcgttcctgaggacccgctatgtcacagcactaaaattaagatttttcttctttgtgacaataccagtttgttatttggtatttacagcgttaacaaaacaatccgtttcttctgaagatattgaatattacccgcagacaccagaaattactggatcgcggaaattgcttggcctatctttcaccgatgccaagaattcgagcctggcagatgatcatggtcataactgcacgcccgcagctatcttagattttccctctgatggattcaccagggagcaaagaagacagggctgggcgctggtccatgccgcatcgcattctactgcttcttggctattagcattagtttgcgatgactacttcgttccggcaattgagatgctgtgcaaaaagctagatatgaaggaagatgtcgccggactacatcatgggcgctgccagttctagtcctgaattattattaattcngnaggacttcatacagaaggagacctcggggtcggcncgggcgngggttcatctgnatttaatatactggccgccctgctgtgnggggctctttgtgggaaggtagtanaatttaaatggnggccagaacctcgggatntggcttgnttggatttgccgaattggccctnttcctacntttntaanatgggaaaagtttgtgggttgaanccctaaccctaaanctggcttatatntttttttngcgctttgtnctn

SEQ ID NO: 1592 - DNA, 943 bp, Ctenocephalides felis
tttntataaattaatatatcgttctcgttgttaccaaattatattatttaaattaagtgaaaaatatggccagtgttgtgaagcagttgccaagaatatccggctccaaagtagcgaaatgcatttcgagccgtaattattattcgtatgtaaatgagcctgcccaacaaatcaaagacaaagaaccgaaatgggttactgccgaagaagccgtaaaaattattaaatcagatgactgggtgtacgctcagggtgcggctgctaccccaatcaacttattaggtgcgatgactgcacatgggaagaagcaaggcctgaagaatgtgcgcgtctgccacatgcacactgaaggacctgcattatacgctcagcctgattgcgaagggatatttagatctgtatcattcttcatgggaggcaacgtacgtgcagctgtgaatgaaggacgaggcgatgcaattccaatcttcctatcagaaatacctcttctattccaaaagaaaattattcaacctgatgtagccatagttcatgtttctcctccagacgctcatggattctgcagtttangtaccagtgttgactgtgccagagcttgcgatgcaagcatcaaaagtgataattgcccaagttaatcctaaaatgcccgtcatttggtgactcattggtgcacaaaaagtcacatagatatgctgtanaaattggtgaaaccgtggtacccatggnggnaaaccacctaatganggaagaaactgcaattggngcacatattgnnaataacttggnggaaaaaggngcccactttaaatgggtntnggaaccattcctgatgcngttntttgccaacttccttaatcncaaaaatnttggaattcatttttgaaagtttggccaanggntaatngcnttaaaggaaagganggngttgttccaaaacctaaat

SEQ ID NO: 1593 - DNA, 929 bp, Ctenocephalides felis
tcaaagaacgtgacaagaaaaatatgtgaattttgtatgttacataataatttttttatttcctcgagtatttgttaatttgcgtgggctgaattttcggggcgaaacttgtgatatgaacaaaattgagatggctgaagctgcatcacctagtacagaaatgccacactcaggtggagaaccagggacaccaatgggttcagttgttggtgcttcaggtgaacttgcggggctgagcccagaagaagctgaattgaaaagagctgagtggagccaagagcttgcaagagtggaagaagaaattggtactctaagaactgttttggcaagcaaagttcgaagaagtggagaactgaaagctaagttaggtatcactgtttggaaagaactaactggggatgtcaatcaaagtctacgtactgttaaagagagtcaagtctatggtaatattgaaaattgtattggacaaataagtaaagcttgtgactagtgcacctatttaccagaaaacagaattggtactgaaatctactgccgaaaaaactacttctttgttaggtggaatactggtggtttgacatccaaaattgtcagatgagaaatctgaatctttcaaatcactagaagaaaaaatgggttcagcctatgaaaacgttaaaacaaaagttcatcatctcgttctaattctattcaaaattttgatgaagcattgcgtgaagcttaacaagattctgttcaacttctactnttcctgaaaantcaatttcaaccagtaccntttgnttcaaagctcctcttggttntttatnaaattttnaaaaattagtaaccanggaaaagtccggnccacccgaagatgttttttcctaccaaacttggttcacatactttnttggaaatcttttccatccaattcattatttttnaag

SEQ ID NO: 1594 - DNA, 938 bp, Ctenocephalides felis
cgnttggctcatcgctactgncgaatatnacaacagtcaacttaggttacaacttgtgngaccttcatcatcttgtacaacaatctcatccccatatctttgcaagtgactttagaagtagtcagatttatgcaggcgatttttataaacatggacgtcctaatgtaccattcagagtctgatacaccagccatggccaggacttcaaatctaaacgaggaattggggatggttaaatacgttttcagtgataaaacaggaacgttgaccaggaatgttatgaagttgtctaagtgttctattggtggaattatttattcttgtcctgattgcccggaaggcagctttagagatagtccggttgatggacttgatattgaggatgctcagaaaagcgatctggttcagaatttactcaacaatcatccaacagtcgacttgcttaaagaatttatgagtttgctatcggtttgccatactgtgatacctgaaaagagcgaggatggnaaaatcattatcatgcatcatcaccagatgaaaagactttagtnagtggtgcaaagaaataccgnttcttcatttgaaacccggncaccacatcaccgtaaaaantaaacgcttggggtgaaattttaaaaattgagatattggatggtctcgaatttacttcaacaggaaaagaatgtttnttgnttggtagaacncccagggccaattaaantnttttggtaaaggaccagattcctggnatnttttgaaaggttngccaaagaggacnccaatttcgngangtaacnttggaaanctttngnccaatttgntnaggggggggcccggtccccaattnccnttaagggnggnggattacaattnntggccgcggtttcnaccncgggactnggaaaacctggnntttcccacttantccttggangcct

SEQ ID NO: 1595 - DNA, 929 bp, Ctenocephalides felis
cttttcgatgttgatgccaaaacagaaccgtgtcgcaatctacgagcacctctttaaggagggagttatggtggccaagaaggactaccatgcaccaaaacacccagaattagagcaaattccaaacttgcaagttattaaggctttgcagtcgttgaaatctagaggatatgttactgaacaatttgcatggaggcatttctactggtatctgacaaatgaaggtattgaatacttgaggacatacttgcacttgcccccagagatcgtgccctccactctcaaacgtcaaaccaggcccgaattggcaaggccaagaccagctgccggcccaaggactgaaggatctcgtccagctgaagacagatctgctaccgtagggcacctggtgcacctggtggcgctgacaagaaggctgatgtcggtgctggcactggagacttggaattccgtggtggatatggacgtggcagacctgccctcaataaatttatataaagtaatttataataaaatatcaataaaacatcttattgataaaccnnnnnnnnnannnnnnnnnnnnnnnnnnnaacttgngggggggccccgggncccaaatccncctttagggagtctantanaattcnctggccggngttttanaacgtngggatgggaaaaacctggngttnccaaattaattcccttggaaaanatcccntttnccagttgggtnaaaacnaaaaaggccccaaccgatcccctttccaaaaatttgcccaccttaatggnnaaagggaaatttgaancttnattttttgtaaaaatccggtnaaattttggnaaaaaactnntttttaaccaanaggccnnaaatnnggaaaatccnttttaannaaaaaaanaancccgaaaaggggtnggggttttccaattggnaaaaaant

SEQ ID NO: 1596 - DNA, 935 bp, Ctenocephalides felis
ttcctgttattgcattcaccaacactgattctccattgaaatttgttgatattgcaattccatgcaacactaagtccaaccattccgttggtttgatgtggtggctgttgtccagagaagtcttgagacttcgtggatcaattccccgtgagaagacttgggatgtcgtagttgatttgttcttctaccgtgatccagaggaagtagagaaagaggatcttgttcacaaggaagttgtggccaaagttgagactgctgttgctcatgatactgctgaagtatgggcaggagatgagccagccactcaattatggactgatgatgcacctgttgctgcagttccggctgtttaccctgctgctgccagccaagattgggccgagcaagtgcaagaagaatgggctgccaaccctaccccagctgctggtcaaactacttggggaagctccacacaagaatggtcataaatcaaatgatactttttgtattggataaatgaaataaatgaaaattaaaattaaaaaaaaaaaaaaaaaaaaaaaactcgagggggggnccggtcccaattcgccttataggagtcgtattacaattcctggccgncgttttacaaccgtcgngactgggaaaaccctggcggtanccaacttaaatcgccttgnagaanaatcccctttcgcaactggngtaaaaaacnaaaaggccccacccgatcgcctttccaanaattggncaancctgantngngaatnggnaaatttgaagngttattttttggtnaaaatcccggttaaatttttgtnaaaaangntnnttttttaaccaaanggccgnanttngnaaatncnttttaatnaaaaaaatancccggaatggggttgggtttttttcnatttggnacaaaaatccctttttaaaaaacnnggccnccanct

SEQ ID NO: 1597 - DNA, 941 bp, Ctenocephalides felis
tgctttgtggaaggaaagtctaaaataagaatataaactatgccgggtaccgggacgttcaaattattcatcggaaatcttgacgaaaaaactcaagcgtcagatatacgtcctctgttcgagaaatacgggacggtcgtcgaatgcgatgttgtcaagaactttggttttgttcatatggagaccgaacagcaaggtcgggatgcaattcagaacctaaacggctacgtaataaacggcgaggccataaaatgcgaagccgccaagagccggagggcgccgtcaaccccgacgacaaagatattcgtcggaaatttgacagataaaactcgcgcgccggaggttcgcgaactgtttcaaaaattcggtacagtcgtcgaatgcgatatcgttcgtaactacggtttcgtgcacttggacgcgagcggtgacgtgaacgaggcgattcgggagctgaacggaatgatggtcgacgggcaacccatgaaagtgcaagtgtccacgagtcgcgtgcgccagaagccgggcattgggtgatcccgacaatgctaccgctgcgggcgtgggggacactggtccaaggagtgtccccgtgccatgggggccgatcgtaacggctttccgggagangatgttcggttgngaccggtaccttcgccggcggcaccggcnttctgngccaaccggatgatgggccggattcccgggattctattgaccnttcttcgatagangttttgatggttcaagggatttatttgganaggcgttnttctggngggaatgcccggtntgcgtgggggggccaaaatttattgccgcccaaggaaaaaancttttgcctcctttccccctttagnaataaaaaangggattgggatttttanggcctccaacttttattccattttttaccggngtttccccaaggngggttgcng

SEQ ID NO: 1598 - DNA, 937 bp, Ctenocephalides felis
aacntttttaagtgatttatttattttatattattgttgtaaaattacaattttcaaaatgagattaggagccacagtacccaatttcaaggctgacaccacagaaggacccatccagttttacgactggtctggcgatagttgggttgtgattttctcccatccagctgacttcacacccgtctgcaccacggagttgggtcgcatggccgtccaccagccgcacttcgtcaagcgcaacaccaaattgctcgccctgagcgtcgacgacttgcagagccacaaggactgggtcaatgacatcaagtcttactgccaggacattcccggaaaattcccgtacccaatcatttccgatccgaaacgcgagttggctgttgccttggacatgatcgacgaagagcacaaggacgaccctgctcacgccatgaccgtcagatctttgtcgtgatcgatccgaaccacaaattgagattggccatggtttacccattcagcactggacgtaatgtcgacgaaagtattacgtgtgatcgactctatgcaattgactgatcgtctgaaagtcgtcgcaacgctgccaactgggttccttgggggaaaaaagtaatgatcctgccttccgttcagaatgaaggaagcagccaactgtttccaaaaggtggtgacacttgttctatgccttcaggtaaaggttttggtgcccncaccgactggtttttnaaaaaaaacaagaactttttttgnttccttaaaaatttttaatccntttccaaatntttgcnaaaanttttaattttttttttatgaacaantttttgaaccctaagcnttttaaanttttntttccgggatcaattanctttaaggatgggngtttttaaaaaagattttttccanggttttntaaatntgggaaacccttttttgnaatntt

SEQ ID NO: 1599 - DNA, 648 bp, Ctenocephalides felis
gtcttccggccagggggcctttggcgggacatacacttgtgagagcaagggcaccgccgtctccggagccgttttgcccggagcaccaggacgagaggctaggattttactgtttggcgtgcaaggaacctgcctgtgcgagctgcctgcagacggagcgacacgccagtcatgacgtgcaggcgatcactgcaatgtgcaaggcgcaaaagactgaattatcccaaaatctgcaacagctttctgaaaaagcgaggtctacgacagaattcatacaacggctaaaagggatgagtgacaaggttatggaatcatgtacagaatttgaacacttagtaacagcacaatgtgatgcattgatcacagctattttaaataggcgagattatctcctagaggcaatacgatgtgatagagaagctaaactcagagcactcaaggaccagcatcaactgctacaggaaaattacaacacacgacaggttaatacaatttgatagaggcttcaaagaaacgatagtgtgattttacaggtggttcatgtatagccganggccaacgacatcgctgcatcggaggnagagcncgcggtgtttnacagtcatctacctgacgacaggcgtctaggcatgncattacttntcaang

SEQ ID NO: 1600 - DNA, 650 bp, Ctenocephalides felis
gatgctcttggggtttccccagtgggtccaccaatgtaaataatcgaatcgttggaggcaaagacaccacaattcaagaacatccttaccaagtatcaattttgtacaatgatgaatatcacagctgtggaggttctttgatttctgaaaaatgggttttgacagccgggcattgcatcgattctttcaaattctacatccgtgtgggaagttctcttgaaggcgaaggtggagctgtgcatcgagctctaaaacaatatcgacatgaaaagtttgatgcaaaaactgtagattatgattatggattaattgagttagacacaccggtacaacttagtgaaaatgtaaaattagtcaaattggctgaacctggtgttgaacttgaagaaggaactctactaaatgtcacgggatggggtagccgtcgatccagcgcagctctacaaatagtaactgtccatatgtatccgaagaagtctgcaaaaaatcacattcagacaggtgatctcccatatatgtctgtgtggtaaaatgcaggaggagaagnccttgcatggtgacttgnggccagtgatcaatggntcaattggattgttctggacttgatggnctccactttctcgttttgtaatncgntntcagatggtaag

SEQ ID NO: 1601 - DNA, 649 bp, Ctenocephalides felis
atttnagccaaccagcaagcagaaacattgcagactcaattaaatctaatgtcccagcaacgagatgaacttttggccaagatgagtgacactgaagacaaatataatagacaagttgctgctctaaccaatttgcaatgtgccttagaacaattccaaagagataaagatcangaaatccaccaatgcacagaaaggataagaaaccaattggaattggaacgacaggaacaaactgctttaaggaacgaaatccaatccctaaaaacgcaacttagtgaacaacaacaaggcctgatggctgcaggaagacttgccagtcaacttgaatcctcacaaacaactgtacaaaatctcagacaagaattgaaagagagccaagacaaatacgctgctctgaccgccaaagtggagtcttcaaaaaacaaccaagccgacaaaatcgagaagagcttgtaaaaacctaatgctcggtacatccagctggtcaacaaaacgacangcacaaatctaaaatatatagcagtctcgacttcaccagtcggatgcgaccgatagctttgagcaccaaaatatntggttgagatctgtctggatggagagaggctgtaancttgcnattttgggaagatttaccaacgntnggagg

SEQ ID NO: 1602 - DNA, 646 bp, Ctenocephalides felis
gttttgtggagctactggtagagctagcaactttttattatccgtcaggtgtgttaaggaaaaagataaacctgtgtcgatgggttttggattgatgataatgtccttgtttgccttcgtaccgtcaccaatattttttggagcaattctagatcaaacatgcatagtttggggaaaaacatgttccggaactggaaactgctggctatatgatgttgaatctttgcgttacatcatgaatttaacggcagcttcttttgtcacaattggagtattatttgatgtcggagtttggtatttcgtcaaaaatttaaaaatttacgatgaacctgatgatgacgaccaagaaatgaattctttgaaggcgcaaaaggcggatggagctgctgcaacttattccaatcgaatctctctatacaaagtcatataaagaatagtacttgaggaatttaaaattaatttaagttgtaatgcaaaaaatgtaactgattaaaatatataaataaataagtngaactataaaaaaaaaaaaaaaaaactcgngggggcccggtcccaatcgcctataggagtcgatacatcnctggcgcgttacacgcggctggaaaccctgcgtncactaatccttgagacatcccttcgcagt

SEQ ID NO: 1603 - DNA, 643 bp, Ctenocephalides felis
caancatccatgttttattctgtatatatgtttgtgatggcaattgtttattgatatgaaattaaattaatatttcgataaaacattcgttattattagaatatttgttctagataagttaaattattttaaggggtcttaagtatttgttttatttgttcgtttaattgtgatgtagaattgtgagaattcaatataatatattaaaaatgtttcggcaagacaattcaaaagcttttatgaaagaccctcatactgcgaattgtaggatttatattggaaatataaacgagcatgtgaattctcaagaaatagaaacacatttcgcaaaatatggaaaaattctcggcgttttgctacacaagggatttggctttatccaattcgaaaaggaacaatctgtcaatgaagccatcaaaatggaacatcaaaatatgtttcatggcgaaacatgattgtgagacgagccaaagcaatgtaggaggagcaggtggtactctgcaggcctgtacgcaggtctctccgaatcgtgatcgggccgttccagnactcacacatgagggcagacaggtctggtccggcctgtcncttgtgcctcgcattgcagcggagtggttggggctcaaagcnggcgtgtgtgaan

SEQ ID NO: 1604 - DNA, 651 bp, Ctenocephalides felis
tgtttatattccttcaaaatgtccgtacgtgtgcaattcgaaaacaacaatgaaatcggtgtttttagcaaactaacaaacgcttattgtctcgtagcgatcggcggatctgaaaacttttatagtgtcttcgaggctgaattggcagagactattccggttgtccatgctagcattgcagggtgtaggatcattggcaggttgactgtggggaataaaaatggtttattggtgccagcttcgacaactgacacagagttgcaacatataaggaattctttaccagaaagtgtaaaaatacaaagggttgaagaaagattatcagctttgggtaatgtgatagcttgtaatgattatgtagccctagtacatccagatcttgataaggaaactgaagaaatcctaacagatgtctaaatgttgaagtattccgcaaacagttgcagtaatgtcctagtaggctcatacacagttttaagtaaccaagggggcttagtgcccccaaaacatncatacaagacaagacgagcttcgtcatactcaagtccgtagtggccggacagtnccgagcaggagntttagcagaggttgnagcaacattgngctctctggggatggccnacncactgactagtggatgaagcggtcacn

SEQ ID NO: 1605 - DNA, 637 bp, Ctenocephalides felis
gttttaaagaatatcaagtgtaaattaaacgcgatttaaatttattgtaacatcaaaatggtgactttgacatcttttataaatacattcaacaataaactggaagcgccagtccagcaacatctcaaaggcgtctacgggtgtctggcagctacaacatcattagctagtataggggcttacagtttccttgcaggatggctctcagcaggattgttgccggctttaggagccctaggattaggcttgggcttgatgatgacctctccagatgccaaaaattttaatatgagactaggaatgctgttaggattaggattcttgtcaggtttaggattaggacccttactagctcatgtggcccaaatcaatccaagtataataacaactgcattatttggcactactttagtattcgtggcattcaacttatcagcaatatttgctgaacgtggaaaatggtattcctgggtggaattattgcagcgtttgaatatgatgtcttctcctcttggcaattttctgcaaagactttgnttcnagctcccttntgagatattgtntggggcttggccttatgatccagctttnttgaaaatcanactggacccaccagtggctctttgctgtcttgatt

SEQ ID NO: 1606 - DNA, 644 bp, Ctenocephalides felis
gtttttcagcctatgcatatttaggagaatttnntggagataaaacaagagccagggcaatcagttggggagcttcttttatttctatgggaatggtatttttgccagcaattgcttggggaataattcccctcaacttcagatatcccataccaggtttgggcatagactggacggcctggaggttgtacgtcctgatctgctcgcttctaatcttttgggcctgattatgattataacatttccagaaacaccaaaatttttgttggccactggaaaaactgaagaagcactcgatgttcttgctaggatgtacgccagcaataaaggccgtaagccttctgactttccaataaaatccctggacatttctggtgtttctggtaacctggcaaaagctggaaatgctcgtgaaattgcttctctcatgatacancaaacagttccattattcaagaaaccacttgtaaatcacacttttgattgtattgtgcagttggaatgttgcatcttcagtggcatgtcatgtggtccagtgatagctacgatttgatgcatatatgacaattngcactatatgatgctgtcagttttgataaggccaatcctccatccttngacaatntgctcaangatccgggttc

SEQ ID NO: 1607 - DNA, 650 bp, Ctenocephalides felis
gttgggcccaatggtgtaggcaaatccacattcttgaagttattgactggtgacatcacaccaatcagaggagaagtaaaacgcaaccatagactgcgcatcggtcgttttgaccagcattctggtgagcacctgactgcggatgaaacgccggccgagtacctgcaacggctgtttgatttgcaacatgaacgtgcaaggcgagccctcggatctttcggtttgatttctcgtgctcatactgtatgcatgaaggatctctcaggaggacagaaggctagagttgcattagctgaattatgtcttaatgcgcccgatgttctcattttggatgaacctacgaataaccttgatattgaatcaattgatgcattggcagaagccataaatggatataaaggcggagttattgtagttacgcacgacgaaagacttattagagaaaccgattggccttatatgtgatagaagatagaacgataaatgaggtggatggagattcgatgactatagaaaggattattagaaagctgggtgaagtagtgaataatcaagtattgccgtaatgcanagtatcataaaagatatacatatacataatgctgatttacttcaatctatatgatatgcnttgnaataaangataagaa

SEQ ID NO: 1608 - DNA, 637 bp, Ctenocephalides felis
ttgntcgtcgttttggccactttggccacattagtggcagctgatggaggatacaaaggttacaaaatctacgacgtgactgtaacaaattcaatccaagaagcagcccttagatcaataggtaacagtggcgaattcgatttctggagtccctcaagggtccttgtaaaacctgaacaaatcgcaaaattcgaaggacttttgaaaactggaggaatcgacttccaagtttttgttgacgacgttgacgaatttgcacgtaaggaaaaagccgaaaatgaagtcgccgaatctagggccgaagggcgcttgtccttcactgcttatcatcgttacgatgtgatccaacaatacttgagcgaaatggcatccaaacacccagatttagccaaggtcgaaaccatcggcacttccagcgaaggaagaccgatcaaagcgctgcgcttatccagcggaggaaacggtacaaaccggttgtggtatggcctgcatccacgcccgagaatggtggcaccaaccaccgcttgacttgtagaccaaatctggaacggccgacatattattgcgaatggatgggtcatcattctgtttaatctnnggtacaatctctacctgggacgtttgagaaaccgacaga

SEQ ID NO: 1609 - DNA, 642 bp, Ctenocephalides felis
gacnncggtgatgacagaggccgggatggcgattggacatgtcctagttgttccaacaccaactttgcttggagaaatgcctgcaacaggtgtagtgaagaaagacctgatggtgcaggcggcggtgactccggccgaggtggtggccgtggaggcggccgcggcggtggtggtggaggtggtagttacggtaaccgcggaggtggtgatagagattctggtcgcggtggtgatagaggttttcgcggaggtggtggccgcggtggcggtggcggttatggaggtggccgcggaggcggtggtgatcgtaattctggaggaggtggctcaatgcgtggaggagatagaggacgagataggcaacgaccttattaaataattagcttgtaattttattcaccctcattttcacatcattcgtactcatattagatttattgatttttagaattatttatatgatttgtatgattcaatgtaacacaatattgtaaatcttatattaagatttaataatataaaataatagaaaaaaaaaaaaaaaactcgngggggcccggacccattcgcctatagtngctatacaattactgccgcctttacacgtcngactggaaaacctgcttnccacttatcgcttna

SEQ ID NO: 1610 - DNA, 634 bp, Ctenocephalides felis
acttttcgatcaattcgtattagactttttgataaaaaatgctgtctaaagcttcgcttttggccaaggtatcccggccactgactgtggcagtgcgaacaacatcccaggctgcaacatgccctgctcctacaaaggtagaagaagccgatagtgctgaaagagatttggtcaacttcccaaggccaacacgtttggaacattcacctaaagttcgctttggattcattccagactcatggtttgaatttttctatgagaagaccggtgttactggaccttacatgtttggaactggtttaattacttacttatgttcaaaggaaatttacgttatggagcatgaattctatactggtatttcattgggtattatctgtctctatgccactaaaaagttgggtccacatattgcaaaatacttggacaaagaagtgatgcctatgccgatgaatggaattcagtcgtgtagaagaagtaaaagtaccaagatgccattgaaggagaaagtggacaatggagactgaagncacttatgtgtggtgccaacgtgaaatgtgcctgcacttgacactanaggaccncntgaagtnntagaggtagaaacatattccagttggaaangaanttgacn

SEQ ID NO: 1611 - DNA, 639 bp, Ctenocephalides felis
cannatgccacgaggaaaatataccaatcacaaagggcgtaacaggcatttcacaaatccagaagagttagaggaacagagaaagcaagaagaacaaaaaaggcaatggcgtagggatcatggaaacgaatcaagttctgaggaagaggaagtagccaaaaaagctgcaggtgataagaagaaagccccagggctggaaagctctgattcagagagtgaatcggagactgaatcttcagaagatgagaaggataagaagaaaggtgtatctggattgatagaagtggaaaatcctaatcgtgttcaaaaaaaaaccaagaaactttctactttaaatgaaacattaactgatagcaaaccacaattgtcaagacgagaaagagaagaagttgagaagcagagagcgcaagcacattaccaaaagcttcatgcagaagcaaaactgtcaagcaagatctgtttagcaagacttgcatcattaaacacagcgtgaagaacagcttaaagaccgagttggaaaaaaaaaaaaaaactcgnggggggccggacccattcnctntgnngtcgtntacatcatgccgcgtttacacgtcggntggaaacctgcgtacccacttatccttgagactcccttgccgt

SEQ ID NO: 1612 - DNA, 640 bp, Ctenocephalides felis
atttntgttggttaactcgagcagtaagaatatataaaaatggctgcagttggcaaagatttagaaaaaccaacagctgaggtgcctcaggtccatcgcatccgtataactttaacttcaagaaatgtacgttcattggagaaagtatgtaccgatttaataaatggagccaagaaacaaaagctccgtgtgaagggaccagttcgcatgccaaccaaaatcttgcgtattaccacacgtaaaacaccttgtggtgaaggttcaaaaacttgggatcgcttccaaatgagaatccacaaaagagtcatcgatctgcactctccatctgaaattgtgaagcaaatcacttccatcagtattgagccaggtgtagaggttgaagtaacaatcgctgatgcttaaattttgtaaattgatggaaataaatgacaaaacctaaaaaaaaaaaaaaaaactcgagggggggccggtcccaattcgcctatagtgagtcgtatacaattcactggcgcgtttacacgtcgtgctgggaaaccctgcgtacccacttatcgcttgnacacatccccttcncantgcgtatangaaagccccncgatcgncttncacagtgccanctgatgggaangcaattgnagct

SEQ ID NO: 1613 - DNA, 644 bp, Ctenocephalides felis
cactttgaggttttgatccttaaccatggtgaacggacgcatcccgtccgtcttttcgaagacatatgtaacccctcgtcgtccttatgaaaaggctcgtttggaccaagaattgaaaatcattggagaatatggtctccgtaacaagagggaagtatggcgtgtcaaatacactttggctaaaatccgtaaagctgcccgtgagttgctcacattggacgaaaaggatggcaaacgtctcttcgaaggtaatgctttattgcgtcgtttagtacgtattggagtgttggatgaatccagaatgaagctcgattacgtgttgggtttgaaaatagaagatttcttggaacgtcgtctgcaaacccaagttttcaaactgggattagccaaatcattcaccacgctcgtgttttgatccgcagagacacattcgtgttcgcaagcaagttgtaatattccctcttcattgngcgttggattacaaaaacacattgacttctccctcaaatcgccttcggtggtggtcgtcaggacgttaaagaggaagacttgagaaaggatcagcgtgntcactgccgaggaaaagagataactttcacatttaatgttatttttcataataaacaaatcgcaaaaaaaaaaaa

SEQ ID NO: 1614 - DNA, 635 bp, Ctenocephalides felis
gtttggacaagatgcgaaagcaggctttctcatctgtatgtctgttcggtgaagacaataacagcagcatttctggtgtttgggtatggaggggtcaggaattagcattcaatctttcccctgactggcaaattgactacgaaacctacaactgggtcaaattggaccccaaatcagaagagaccaagaaattagtcaagcaatacttctcctgggaaggtgccgataagaacggacgcaagttcaaccaaggaaaggtcttcaaataaaattcaactaaagaattgccacttttgttaatatttcaagttattgtaatcttatcctgccacaatattgttatttttatagcaaaatgtttgctgatgatggcatgttatattaaaatttcttgaaataaattatttaaaatctaanaaaaaaaaaaaaaanaaaaaaaaaaaaaaaaaantgggggggggccgggccccaatccccttatagggagtggntaacattcnctgccgcgtttanaacgngggatgggaaaccctgngttcccaattatgccttgaacnatccctttccnantggnnnanagaaaaggcccnccntncttccaaattgccacntnatgggaangaanttgagcttat

SEQ ID NO: 1615 - DNA, 641 bp, Ctenocephalides felis
gtttnagtattttttgttatttcttgacttgatcatctgttcgataagttaattctgtaataatgaaaattactagatataagaaagtacatcgaaatttgaacttttatattaacaattttggttttcatcagccatttcaaatacttattgacggaactttctgtttcgatgcgttaaagaatcaattcaatattcaagatcagttaaagaaatattttcaagctgagcttaaacttttaactacgcaatgtgtaattgtggagacagaaaatttaggacccaaattggttggtgccatgaaaattgtaaagcaatttggtattcacaaatgcggacatgaaaaggctccaattggtgctagtgattgcttactatcgatggtaggcaaaagtaatagagacagatatgtcatagctacccaagatcgtgatctacaagaaaaaattcgggaaaaacctggtgtgcctctattgtatctgcatcgtaaagcaccatgttagagcgcctcacaactagccgtgataagctctggaatgctctggagctcaagtccaacaagggagacttgnataanaataaagagagtggttatcagaaacacatgacagaaaggagagaagaaaagaaggnctatcttt

SEQ ID NO: 1616 - DNA, 636 bp, Ctenocephalides felis
gcattataccgccaattgttgttcactgctccagactctttgggtgaccacatatctggtgttattttgttccacgaaaccttataccaaaagactgatgatggcactccattcgtagaacttttgaaacgcaaaaacatcatcccaggaatcaaagtcgacaaaggtgtagttgacttgatgggcagtgagaatgaatgcactactcaaggattggatgatttggctgcccgctgtgcacaatacaaaaaggatggatgccactttgccaaatggcgttgtgtattgaaaattggcaagaatacaccaagctaccaagctattttagaaaatgctaatgtcttggccagatatgcctcaatctgccaatctcaacgtttggttcctattgttgaaccagaggttcttctgatggagatcatgacttggaacgccacaaaaagttactgaaaccgtttggctgtgctacaaagcttgaatgaccaccacgttatttggaaggacttattgaacccaatatggtactgtggcaaagtgcccacaaaaccacccagcagtgtaggagttgcctgggctgnttgagganactgtccactcagtccggattcttctnntgagacattgaaaaaagctatc

SEQ ID NO: 1617 - DNA, 650 bp, Ctenocephalides felis
aacnncttaaggaaaagcaagctaagcgcaaggtatcccgcgctgaagaagaaaagcgtatggcccaaaggaaaaaggaagaagaagaacgcagaataagagaaattgaagaaaagaaacaaagagacattgaagaaaagcgtcaacgtctcgaagaagccgaaaagaaacgccaggctatgcttcaagccaccaaggatgccaacaagaagggccccaacttcaccatcaccaaaaaggacagcaacttcaacatgtcttctgcccaaattgaaagaaacaagaccaaggaacaattggaagaggaaaagaaaatttctctgtccttccgtatcaagcctctggatatcgaatctcttagcgttgaaaaactcagacaaaaggccaatgaactttgggaatgcatcgtcaagttggaaactgagaaatacgatctggaggaacgccaaaaacgccaggactacgatcttaaagaattgaaagaaaggcagaaacacaactcagacacaaagcattgagaaaggattgatcagagccctacaggaaaatccccccaaatcaagtcgctcaatatgagagcngtcgcacagacattgagatagaaaaattnttgaggggctaaactaaacaagagncttgacgttttgccn

SEQ ID NO: 1618 - DNA, 642 bp, Ctenocephalides felis
gccntgtagcaccaacaaacttttcaaaatctacacgtcattatgaaattttcaaattaaaaagtgttcattaataattatagtgtattatataaatattagttctaatctattgttattaaaatggttctcttaggcaatgatgaatttttatcaaaacttacaaaaatgtttcaaaatgccagaagttcttcatcggttaccttaactatgaaacgatatgatggaagaactacaccttaccctagagaaggcaggccccctttgcccaaaccagatgagcatttatgtctgttaagagccgtacacaaatcaaaaagatttcgactgtaattaaatcgaaagacgcagtgaggtttcacatagcatattgcagtttattaaaaggtaatatggatggtttgaaaaagatgaaaaaagtcaaaccaaaagtgaaagcgcatagacctatttatttaatggtgggtttgtaagtgagcaagaagatttctttcttaaatttatatgtgatgcgagatgaatgctggtcagaaccttatcattttcgatctgtcacttaatcgctaagtattaacccttattaattcnttgatattggatggatattttgaaatagatntgtttatttaaaaaaaaaaaacc

SEQ ID NO: 1619 - DNA, 646 bp, Ctenocephalides felis
gtttcgtaataattacgtatttaaaaaaaaatattttaataaacatgtactcattaagaatattttcaaaacccgttaatggtcttgcaagatttagtagttcctataacgctacaagaccaaatctaaaattaaatgagaatactaaagtaatttgtcaaggatttactggtaaacaaggaacttttcattgtaaacaagctatagaatatggcactaaaattgttggtggagtatcaccaaaaaaaagctggaacaattcatctcgatttaccagtattcaaaacagtaaaagaagccaaagatgcaactgaggctactgcttctgttatttatgtaccacctccaggagccgctgatgcaattctggaagcaattgaagctgaaatgcctctaattgtttgcataacagaaggtgttccacaacatgacatggttaaagtaaagcatagactattaaggcaaaacaaaagccgattgattggcctaattncctggaatattgacctgactttgcaaattggattatgcctggcatgtcacaacgaggaaaatggaatgttctcggctggactttgcatatgagnagtaataacacctagtgggctcgccaaccttggtggaatagggagacatttatgnctgt

SEQ ID NO: 1620 - DNA, 643 bp, Ctenocephalides felis
attgtctgtacaatcgccaaattgtggttgatataagaagaattacaattcttcgccatgacgtcgaaggtttcccgtgacactctatacgagtgtgtcaatgctgtattggattattcaaaggaaaagaaaaagaagttcttggaaactgttgaaatccaaatcggtttgaaaaactacgatccccagaaggacaagcgtttcagcggcaccgtaaagtatgtttacctgacatgaatttaatttgaggtttttaaagtcaagttatactggtaacctcaagttttattctgataaatcaggaagccaaagttatctttggcggacctgcacccagggtcttaaataaattggggaggcatttgccgaaccttttagctttctattcaaagtcgactacttgctgcatgaactacttagtagtaggtaagccaagtaacagtcataatttagaaagtaaagcaatgaggcaaatgccttttgatcctgcgggaataagtttcaccgattaaattgaactatcaattaactttctttgttgtagatgagcacattcncgacaaaatgcagttgtntttgggagatcacagcatgngatgactaggcacatgtcatgntgatgcgacttgaaactaacagacaa

SEQ ID NO: 1621 - DNA, 639 bp, Ctenocephalides felis
gtnnttttgcctggattatttaattagaagactgttaagttttagaagatatgactgtagtttaacagtttatacgttttataaatcagcttctgaaactttaatttcataatgatttctggcgattttcctgaggacccagaaaaggagctgcagagtttagaagatgatgttgttcaagaaattctcaaaactggcactgatctgagacaatactcgaaacaaatagaaaaagaactgaaagatgtagaaaataaatctatacaggattatattaaagaaagccaaaatatagctagcttgcacaatcaaattggggcttgcgatgacatccttgaaagaatggaagatatgttaatgagttttcagagtgttttaggtaatatcagttctgaaataacgtctctacaaaaaaaatctgttcaatgtcattcaattatcaaataggcaggctgtccgaggagatctctcacagttatcgaagatatttctgtactcaaagctgtaccggatttggatcccagtactgagaaagaattatactcagtacaatctcatcccaganagttgtaaagaccacattcaagagccaacttgcatgtgtaggtgtcngagaactgaaataagcatgcaaaataa

SEQ ID NO: 1622 - DNA, 635 bp, Ctenocephalides felis
aacnatacaacaatcgatacgagacccgaagtatacgatataatcaatctaaagtctgaaacagttacaaaaacgggcgatgaaacaggacagtccgcggacattgatgtgcccgacaatggcgacgatgaaaatcttgacatgaaaatcgaagcggaccgactgaaaacattcgaaagatggccagtgagcttcataagcccctcggtactagccaaatcgggattctattatatgaaagtcgacgacagagtcagatgcgagttctgcaaagttgaaattggcagatgggaacaaggtgacgacccctccgtcgaccaccaacgttgggctcctaattgtccattcctacgcaacaggcctgtaggaaacgtgccaatagaccctccgagcacgtcccgagacccggaccgagctacgacgtatgcggcctttgaccatacgtccaacgcgtccagaaaaccaaaacctagcctacctgtcaccaagggcctgaatcccccagtacgcatgagcagcacgcttagatctactccatggccggcagttaaagacgtcaggagaactagtgaagagctttttaccaggcacgaacgaccttgttcntgggngnggtaaagatggaccggatntct

SEQ ID NO: 1623 - DNA, 641 bp, Ctenocephalides felis
gaattatttctttgtggctgtaaaagactgcacagctgctctacttcaatcaccggctgattaaaaaaaacacgtgctgaaaatggcttcgaaagtagcagcaaagaaaggcccagtccaaactggcaaaaaacaacaacttcgcggaaagggattgaagaaaaagaaggtatctcttaaatttaccgtcgactgcaccacccccgtcgaagacaacattatggatgtacagaacttcaaaaaatacttgcaagagaggataaaggtcaacggaaagaccaacaactttggtaacaacgtctcgttggagtgccaaaaaatgaaagtgtctgtcatctctgatatccccttctcgaaaaggtgccttaaatacttgacaaagaagtatttgaaaaagaacaacttacgtgattggattcgtgttgtcgatggtggcaaggactcctatgaattgaggtcttncagatctcatccaagacgatgatgatgatgaagatgttgnataatgtaaatatcttntgatataaatntaatattaaaaaaaaaaaaaaaaaactcagggggcccgncccattcgcctttaggagcgatcaatactggccgcgtttacacgcggntggaaacctgctaccacttatcnn

SEQ ID NO: 1624 - DNA, 407 bp, Ctenocephalides felis
tctccatataaaaccttaaatctttcaacaaaatgatgaagtagctgctgagcataatctaaaagatcatttaataacgtgttgctacataaaattttaatagcaatatgtaaagtaagaaaatttttatagaaagtcatttgaaatatgacatgagatttcaaaactactggaccactatacaataataattgtctaaattctgtagctttccatggtctcacatatttcaatgatcgaggattcctagcaaagtccttggatatataaatctttaagctgcataaaaaattggaaaagtcattagttttagcacatggcaaacgaattggaagctcaccttcagtccacaaaagcatcaatctcttaactgctcctaaacaaatcaaattcatatagtcaagtgg

SEQ ID NO: 1625 - DNA, 345 bp, Ctenocephalides felis
tcatngngcatganttatgtgctttcagcgtgaatttattcagtgccaattatnttcacttacagaaaagattctcaatcttgattattctaaatttccgattangaaaattactcangtagaacttattacgggngccacaaaatnttccggttatttaagggatgattgtatattaataaacgcattngtcaaagcagagctctcattcatgataagtcgataaaacataaaaaaatgtgagtcgatntcaaccctcaaacttacatcttttagtgngggtatggagctatgcaaaggaaaatctttgcaattagatgttcaaataaatctcgtttactggtg

SEQ ID NO: 1626 - DNA, 77 bp, Ctenocephalides felis
cgaacaactttcgacaatcttattgctccgcttcgcaacatgattaatggcagtttttactttacggtaagtgtgac

SEQ ID NO: 1627 - DNA, 285 bp, Ctenocephalides felis
gtattgaatttttctttctcattctgaaagtattctatttcggatggagaacgaatgctgcttggcaaaatcattgattatattataaatcatacgaacaaatttatctcgaatatttattatagcgtcatattgatctaataaaagaaaaaaagcagttcaacataaaaatattggaaaaagtgctatcattgcaaaatatccaagtattgcttataatatcgcaattatatgtataaacttcgcaagtcgagtgcaacgtttaacgtaagcgcggtttgtggt

SEQ ID NO: 1628 - DNA, 436 bp, Ctenocephalides felis
tcgtaattaataaaattaaacttaaaaacgttcaaacgctatcaaataatatatattttgttctcaagtgaaaattgcctttttccagcatatttacataaagattcattaatattagagaaattttaataacaaaaaatatatcaaatatttgtaggccaaccgttgagttacttcctgaaaaagctgcgttgttaaaaagaatcattaattcatcacaacagctcatacgactattaggctctgattactggtcaaagaaagcaaataccttgatttttttttaaatattttgtctttttaccttttgttaaaaataaagaaatatattataaaattatattaataattttccggcaaagaattgttattttgctgtaattttacattttgtaaggcatttttggctaatattccgatcatgtcagagagcaga

SEQ ID NO: 1629 - DNA, 103 bp, Ctenocephalides felis
gagtgctacgatatatactttcattgtatttatttatctggaatctcggcacgttaatatcgtctcaaattgagtagatttccgttgctatctttgataaatg

SEQ ID NO: 1630 - DNA, 436 bp, Ctenocephalides felis
ggcttttcaaagcgctttgaatatcttgatatcaaaaataatatctgtaggtgtatctacttgtgcatcagcaaaatattttctagagtattttagtaaacaaatgtgggcgacgtaattttcttggattattaattcagatctgtttcatattttagattttttattattacaatgagataagtgatttgaatactttgttataaatttctataacctcattaaatttacgaatatttcctcaatcaacatgataaaactcaccactggatatctaatctttttgttctaactttatgcatatttgtcatagtaattactaactgtttattattaaagaaatagatagtaatttcatcttgagaaatgaaaaataacttcgtgataaataattctccagatatttccacttggaaacattttggctctttcaagt

SEQ ID NO: 1631 - DNA, 281 bp, Ctenocephalides felis
aatngngactttnttgnttctaaaaatctgataaaattttaaataacttgaagattaaaaagcttttnaaaattcaacatacaaaaaaatacatgcaaaagcaaatatacaattttaaaaaacctgcaantgtgggncaacancactnattcaacattcaccctgatctttcattctttgattttttataagctacataaantgccaattctttcttttctttgntgatattacgagtatcgtattccaatctgtgcattattatgcgttcaacaagtcgt

SEQ ID NO: 1632 - DNA, 549 bp, Ctenocephalides felis; identical to SEQ ID NO: 883

SEQ ID NO: 1633 - DNA, 549 bp, Ctenocephalides felis; identical to SEQ ID NO: 884

SEQ ID NO: 1634 - DNA, 549 bp, Ctenocephalides felis
agttacagctcctgttaatgctttagctgaaacaagtcaaacttcatcaatatttggtggtgctaaaccacgggaagaacccactgagaaataagttatcaagttttaacattaattattaaccaccatatagaataccatcttgaatcatgtaataatttttcgattaaaaattctgcaaaactcataacaggcgtcgataatcttactcttgcaataaattctttaactgatatataaaatgtatcaagttttgtaaaagaaaaatcaataattattgatttacagaataaaatatttattttgtttaaaaattgactaatactttgtaataatatgtaattcttatatatatagattaaagagttgttgttagtgtcttttgttttcaaatagttttacactaatatatttaatacaaaacgctttacaaattttacaataattgatgaaaactatttgagattttattctcgaagtacaacttatgtattaaanaangngcnnnntgnnnnnntnncctngggggggggccggccccattcnccc

SEQ ID NO: 1635 - DNA, 549 bp, Ctenocephalides felis; identical to SEQ ID NO: 886

SEQ ID NO: 1636 - DNA, 549 bp, Ctenocephalides felis; identical to SEQ ID NO: 887

SEQ ID NO: 1637 - DNA, 549 bp, Ctenocephalides felis; identical to SEQ ID NO: 888

SEQ ID NO: 1638 - DNA, 549 bp, Ctenocephalides felis; identical to SEQ ID NO: 889

SEQ ID NO: 1639 - DNA, 549 bp, Ctenocephalides felis
ccccttccccccttccccacaaacatcacgtgtatttttagttatgaaaaaaaattgtaattattttgatttttggatttttttaaaaaaaaattctctctccctaaaaacatcacctgattaatggacgcatcctatttgtattccttatataaaaataaaaaatgtgaaatttagatatactgaatgattactcgtaccaagagtcgaaacatataaataaataatataaaaatcaatttaccattttcaaatttgatgaattggttgcaaactataccaaattcctcaattccaatcatattcatatacaaaaatacctatcaaattttccgattcatttaaaaccgattacaatcaattccattaggcaccagtatttataaataaaattttgcgcatatgtgtgaacatatattcattattttattagtctgagaaatagatgttgactattcgagagagcagcgaaatgtcgatatttgccacctcatcagatgttggataaccaaccgntaataaccgatttttagggggatgttaangcct

SEQ ID NO: 1640 - DNA, 549 bp, Ctenocephalides felis; identical to SEQ ID NO: 892

SEQ ID NO: 1641 - DNA, 549 bp, Ctenocephalides felis; identical to SEQ ID NO: 893

SEQ ID NO: 1642 - DNA, 549 bp, Ctenocephalides felis; identical to SEQ ID NO: 894

SEQ ID NO: 1643 - DNA, 500 bp, Ctenocephalides felis
acatcaatgcaagagaagacaccaacaaaaaataacgaatataaatcgaaatttgcgaaattaaaaattcgtgatgatcagataagttacaatattttgcaattcttttaaagtaaatatccaaagttttaacattataaaattaaaaaaaaaaaccaatggggaatttggnttaaccaatttttgnacctnnaaagnaattnttttttttgnaagnaccnnntnnaaattttgnttgggnccaantaaaaaaaccgnngncaggnatntnttttttcntacctnntggatnnnttttacctnttacnntggtttttaacntattttaaaannnntttgntttcngaggggttanntttannaaatgncttaaaaattttaatnttttcntttnnaggnttttttgggggaacnttttttaaaacctcnttnttanantattcnttggaacccgtggnaancatttgggtttantanttaaaggatatnggnngggtttt

SEQ ID NO: 1644 - DNA, 500 bp, Ctenocephalides felis
acacatagcaaattaagtcttcgcttggatttacatgaaaattgccaaaaaaagaatacattcattataggaagtatttattcaagtattttttgatgactgttctagctgttcatcaattcatacttaaaatagttaccctttttaatttttacagtatttaaatttaatagttggtatagtattttataaattttaatttgaagcattcctttataggtttggaaattatatttttacaaaaaaaaataacccgtccaattgattttaaacaaaaccataaaaaactaggtgctatagtaaacagcatttgatttgatgtatacattgcattgaaatgagtggagaagcaagatgaaagcctatccattaatgacttaagactttttagaaatgttttatatatacatatgtatgctagatatttagatggtgtcttgtaattgaattagatttacaaggaaccaaatgttctacattaaaactaaatttatctctat

SEQ ID NO: 1645 - DNA, 500 bp, Ctenocephalides felis
acagttttttttttcctcaaacacgagctattggaaaacaaaattaattaagtttagttgaaagtcaaattgacccatatatatatatatctagttttgatatttgtcttacagattatggttgtcgatttatatatgtttttattgaatacttgtgatgtttattattgatttctttttgtttgttgttcatcaacgttctttgttaacaaatgggggaatagctagttaggaacccaagacgtcatatatctggccgaaagcacaattactgaaggcacacacccacaactacagtctacgctcaaattcatattaagtaaaccaggctctggacgtgcggccaacaattatggataccgctacggggacctcaaacatcgttggaaagtagcaacaatttttagagccgagggcggctctggtgtgacaggggggcgtgtgacgataatcataattatcgcgtattgataattattgtcgctgatggtcgcaacccc

SEQ ID NO: 1646 - DNA, 277 bp, Ctenocephalides felis
actgaatgttacaaatttttacttggatagaaggagcaattttcgttgccctcgaccggcgtttcgccagaatttaataattgtttattttattgcatttaatcctctttttttaaaatgatgcatattataataatatacttttaaattattattgatacaacttttttgcaaaccaaaataggtatgatcttttaataatttttatcccatttaaaaaaaattctattcaacaaatatctttttttcaatgcaactaggattttatatgttaagt

SEQ ID NO: 1647 - DNA, 500 bp, Ctenocephalides felis
acttaagtaatatgttagtaaatttatattaggaattatgacaaattttgttatattagaacttatatatattaggctttacaaaaatgttatttggatgaactattttatctattagatttacttaaacattatagagataggaaaaaatctcttaaaccattttgctaaaactttgagaacgaaaaaataaaacatctacaagacatcaagtcttttcttttaaaagagtaacactcgaaaagggagcgttcattcttagaccaaaagaactacaaacatattatattttataatatagaattattaatagtagtatttttttactaatataaatatgtttaatttcaggttattttgactcgtcatcctatcaaattagtcaagaaaataacgtcaacagaagtcagaaaagaaccaaaaaatttttctgctcaagtgcaaaaagggctacacttattcacgtggttgcaacaccacataaaatacgaatgtggcaa

SEQ ID NO: 1648 - DNA, 331 bp, Ctenocephalides felis
acagtagattgttttgaaatcggtgccgtcccgtaagtgttaaatatatgtaagcaaaatgattttactcaccaatacatcataccccatgcaaaaatacttttatagagtaatgcaacacgcttacctgaaacaaaataaaaattattaaatacattgcaaagaaatatataaggtcatgaagaaaaattttatgtaacgcaataattatatgtagtagcagtcttacaaaaatatgtattaactaacaatatcaatagacaattatttaggggccaattctgctgtaaaatagaccaatgttaagtaagggcttctcatacaaaattgt

SEQ ID NO: 1649 - DNA, 113 bp, Ctenocephalides felis
acgagttaataaacnttnaaatataataagtaacattttaaagntgcatcttagtgaaaatctttaccatgttccttgaaaataataaaacaaantaaacatttgtgccatgt

SEQ ID NO: 1650 - DNA, 474 bp, Ctenocephalides felis
acaggaagttccagcaatttgccttaaggcacgatgccatacgccactagtttttgttagttgtatgtttaattatgcattaatcaaataattttttcatagttcaaaaccagacggtttttttttaaaaaaaaaaaagaattataaaaaaatatgttcaatgtgacagccagttgtgttcatgcaaggcgacggaaagagcactcgtgtcgagcaagcgatttgcccgctacacatatcagtttggtctgacgagtatttttacngngcccgcctatagtgtgttaatatgatgcaattcagtcattatcaacacgagacagtctaataaaatttatttaattttagctattatatcaattaaaaataactatacgtctctatttatttttgttccggttactagaaactggatgaaatatttagtcatacttttaagaagtaacacttccaatatggacgaatttttggggt

SEQ ID NO: 1651 - DNA, 500 bp, Ctenocephalides felis
acatacacacagatatacatacatacctacacnaacacacacacatacatcatttttttcttaggtatgccaaaatgttcagagggctttgaaacgtaaagatatgtaaaaaatacattttcattttgttgcgaacataccctactggaagtaaataaaaatgcntgaatcaagcacagtaatgggaaaaaattaactaaaaggttagttatcgtataactaaattaaatcaaagggctgntttattatttacagttnctcaactacaaactatataagtcaaactcaaaaaactataaatacttattccaagaaattaataaacttttaattcaatgaataataaaagcatttccctattattngcttcaataattattataaactattaaaaccatttatacattgtttataacttacaagaaagcancttaataaacttgaaatctctaataaacaacattngcaagactttntaatccatcaaaaaatacttgaca

SEQ ID NO: 1652 - DNA, 500 bp, Ctenocephalides felis
acatgctaagtatcaaggatgacgctgtatgtgaaaaaagtgagtgttttccgctttcctgttgaaatctttcttcaattttctttgctacaaacttcacggagttcgagacctttccaacgaatgcaaaagattcgtgcgttctggagttatatcgtcaggaaggaaaacccgtcttatttttatataatagataatatatactatattattatagtaatcgggcgtaacatcaataaaaaacatgaattttagtgttaaattagaatattaactaatttttcgactgaatgagggctangaatggaggcaacatatggatgtgaaaaaactagtatgagagtttttagaatttttttaaaattcatatgcttccactagcatagccttcattcattggcaatcaatttaactgtaaaaattaaaaataaataattttttattaacattattgtttttttatgaaactccttacatattatttatttagttttaatttt

SEQ ID NO: 1653 - DNA, 226 bp, Ctenocephalides felis
acttaaaaataatttctataaactgttttagattggaaacttatgcactaaattaaaaatattgnattgataataaggtgtgattgcgattttaatataaaacctcacttaacctagaattaagtttatacattatacacatcagacttgcttaacagcaactattaaaaataaatcaaatatggtatatcaaaaatgatatcaaagtaaattggcatatcaaagt

SEQ ID NO: 1654 - DNA, 500 bp, Ctenocephalides felis
acattttaaattaaatctctaaatgtatattttttattaatattatttgntatctatcatatgaatgaattattcgtaattgtcatatacgcttaactatttctgtttgatcaagcttgattttaaaattttgagttattatatttctgtgttcattcactacatatgtattatagtttctctacacttgtctgcaaaatcattcattaaattataactcatatccaatacaaatgatatgtttgtatttaaagaactgacatctcgaaacgcaaaaatttaccaagatgaccaataatatttctttcattttcttattatgaagaatcattatttgtggtaatttaattttgtatgataaccattgtgatcaatgctgtaacatttgttaacaattaaattatatagtttatgttgtatacatttagacctgtaagaagcgatatttaatattattttttataatttgttaatcttacatatatagataaatattatgt

SEQ ID NO: 1655 - DNA, 500 bp, Ctenocephalides felis
acattctgaacaaactagataaaatgaaaatcatgatatcagttttattcttgttcttagttttttacgtaggatttaacatatcaacttctatttaacttttccaagtttcgtctttaaataaagtttgttatcggcaaacacaagttttaaagagaattattccgtttgtctatttttactagaatacttttttagtgtaatttgaagtagtaagtagtatcttggaaaaagataaatttaacgtcctttgtaatcgacatattaatatcgaataaatttgatactgatgaagtattatttgttagcagaattttccaataattagtttaccataatttattaactgataatgcacacaattttttaaaaatatactttttaaaattaaagtcttcaattatttcaaaatagttcaatactcaatctaataataaatttaactgttattcactatcctgccacgatttttaaattaggcttcgttaaattcaattttg

SEQ ID NO: 1656 - DNA, 343 bp, Ctenocephalides felis
actaatttttttaaacatttttttaccctctggcaaatatttccctaactgtaatgtaaaaattgttcacaaatggnaattngcctgtcattcatgttcgaacgttttaatngcatgtttgcatttgcaacacgagaatcataattctcttcttgataatttatttntatgtcatttttagtcatgaaaatgaaatatataatttgtaaataaatactcagttcatacacgataatgtaattataggtagtgtttaaaaaaattagcgactgtgaacaagatatcaaaaaaatacacatttatttatttcactatccaaagttttcttacagtcctctcctgt

SEQ ID NO: 1657 - DNA, 500 bp, Ctenocephalides felis
tcaantntgaactgcantngntaactgnntttnatgatcnantcnattgaaaanaaangtnnctaanntnaaangggcntgacgncnnctgtcttcncattatgtnctatgctcatcagtttataagttaaagttgnncacctctcntntatagnaaatanatgatgactattgcgaaagaagtctagactataaaaattctaacatatatatttaggtanttgatccatanactagggagngaaagacgtttaanatacatggnttccanaatagtcaacatgatttaaccacattttgtatgttataagtatgcaagcntgttgtgcntgagatcgcgaccacgacctangtgatangcanctcngtngcgaccactctaancngaattttgcngatntacatcacactggcggcgctcgagcatgcatntagagggccaattncaactatagtgagtgggaaaacnatgcagttgcccnacttntnacttgcatgac

SEQ ID NO: 1658 - DNA, 500 bp, Ctenocephalides felis
actataccggtgcttaccgtggcaagatgaacgtcccaaaacgtcgctgatcaaattaatagtcctcgtggctaatttatttattctggaaaatcgtgcgatttgtttgtgttcacaaaatttccgtttaccaaattttcctctataatgttcggagtgttggccgccacctcgatttggttactattggcatgggcagctatgctaatatttttccttccgttgatgttcgttgtgttagcagttttgccgggactgccattactgattattcgaagggtgtgctacgtgcccttcgattcgatttaaatttgatttcttcaattaaaaaatcaattttaaataaggcagtgttctttgaaatagttatttaatcgtgtcatttcatagtagttgtgatattatatttttaaacatatatcttctaatcattgataagtatgatatttatacatagtcttacatattaaggtataatatataatagatatagtcgtatt

SEQ ID NO: 1659 - DNA, 500 bp, Ctenocephalides felis
actataatttcaattcaatgcatttttggtnagccaaaaattatatgaaccatttgtatgtttgttaattcaacagttattcgctctggattctttaaattcgaagtgttactatactgatgatattacaaatctactgcaattaaagattatttattcattgcaatattagtatatagtaatatttattagctctttgacaaatttgtctatcaaaataattaaaccttttcaataaatttttataagatacatagtttttatctcctctacttaataaaattacatcattatttgaattaagtggtttatataagtgcaattttacttatttacaatatttttctttgaactcattaaaataaactcaatctctaattttatgagttgtccatttagtatgaataaatatgaacagtttcttgaaggtttttgatctcggccataccattttttcatatattgtctatatacattttttacaatgactatatatcata

SEQ ID NO: 1660 - DNA, 343 bp, Ctenocephalides felis
actagattatcctgatacttttgcgccattcctttcgccatagaactagcaactaatttctcaccgggaatagcaaactgatgtgaagcaccacgaagtttagattctttaacaacttgctcattttctagttcctgcagtttattataatattcttcgcccttcttacttttgactgtttgctgccattccgtttccgcttgcttaattacttttggtctcaaatgttctggatttaattcaattcctccttgttgagccaataatgcttgtctttcttcgaaggtcttctctaattcagttcctacacgttctttttgatattgtgttaggtcgtagtcgt

SEQ ID NO: 1661 - DNA, 500 bp, Ctenocephalides felis
ncttgtgcaaaagcaacattttgacattatangtnngganattgaactaaattnaattataaaantatnantnantggtaaactnacantattgaacatgttaatnttatattccatgtttagcaaagaagctcctaatttaaaacaataannnnatncntgcgcnatcaanctttcttggttgngcatgaagtgtgatcattaaattataagtattctcaagtaagatctgaaaactatatcaaaaatgtataattaaactaaaaanatatatttattatataaatnttcctatngcgacantanncantttttaatntnaatgagnaatgtatnaaggtgagnntntgctcgtgcgaatgntatnggncnttnaganaattnaagaattatggtaantattntngaatggattgcnttatngnttcctaaatgncctctggttagttnaaancttgtatgantngagacacagcaacaactgttgctgnntttatatt

SEQ ID NO: 1662 - DNA, 334 bp, Ctenocephalides felis
acactgcaaaatttcaaatgcgaatatctcgaaaactaatagaccaagtgtcataaaattttcacagaattttactaacactattgtgcataaacactatgagtttaatcgaaatccgagatgataagactttttcatcaaaaaatttttagngtatttgatcagattcatttntnantttccggcggttttaaccaggaaagcatacgagtattaaaataattattatatggcgttatatctcgctatatgacctacaattaatttccaattnggaccctntatctgccccacacgccgagcaatcgtcaaaaaagtgagaattttttttggt

SEQ ID NO: 1663 - DNA, 500 bp, Ctenocephalides felis
acttaaaccaagaaaaaaaaaaagcttttagcctggcgttgacatatagagaccataagatcgcaacacgagaacgatgtctggacattttcgaactcacatatactagccacccgcgttgtggcgccttaaaaacgtagggatgaaatgtttacacaaaaaaagagacataaatattatcttgctgcgttacttaaatgtctatgatttgaaatcgaattctaagagaaaaggacttcaacgatatcttacccttgcaatatgatattttaaaataactttctttaaaatatttacgactatatataaaaaaaaaaaaaaataaactctactcacaagaacgatttccatgaaacaacacttaactgtataacataacttaatgtatctggcaatcatcatagatttttaaaaaaaaaaaaaaacaaattattttatgtattggtgtttacgaaaatgattatgaataacacaatacactaaacaatttcaataatgtc

SEQ ID NO: 1664 - DNA, 500 bp, Ctenocephalides felis
accgtcaatcactttataagtcctttatatacttgaatataaaaatgaagcaaattgctaataaacctttcctcaaaaacatttgatgaagagatttcgacttctcaatttagcttcacaattcttcaaatagagagtgaaattacactgtagagactaaaacagaaacgaggcttttcatattttcacgaaacaatgattacatattgtagactcatgttcggtaacatctattctgcataatcatgcgattagttgttggacacagactgtagatgtcctatactttctaagaatttttatcgaagtgcacaaactagttacattcttgaccaacaaatatattacgggcaggaacgtgaactaattattgatctgatcaatagcttttccctaatacggtgaacgtgccctattaactttatactgtaatcttgtaatgctcttactcggccataaaataatgatgtggaaacccaagactaaagcctaagcaggtg

SEQ ID NO: 1665 - DNA, 433 bp, Ctenocephalides felis
acacaacatattaagctaatgaactcattgnnnaattgacntatntatattattnataactaaaagtctgggagtttacatatattaattattttataacagcttgcttaaanttgactcgttngctatgcaataantacctaattgcaatttaaagtttagatctcgaacttcacanatcntcctattaaaagntgtttacagnanttggttnnggatcnantgnntggcaaantaatantnnaatatntgtatgnnagatttaatctccantcatnatcttcatgnattcatcgaaancgacagttcctgatccnnnagtatngatttncgcgatgatnccntccangtcggacgagctgagtntgcgncgagcgctcccaagatctccttcagccgtgctggntgtgangnaaccgcnccttcgtggcgt

SEQ ID NO: 1666 - DNA, 500 bp, Ctenocephalides felis
acttgtgcaaaagcaacattttgacattataggtttggaaattgaactaaattcaattataaaaatattattaattggtaaacttacaatattgaacatgttaattttatattccatgtttagcaaagaagctactaatttaaaacaataaataaatacatgcgcaatcaatctcttttggttgtgcatgaagtgtgatcattaaattataagtattctcaagtaagatctgaaaactatatcaaaaatgtataattaaactaaaaatatatatttattatataaatatttactatagcgacaataaacaatttttaatataaatgagtaatgtattaagttgagttttgctcgtgcgaatgtttattgtttatagagataattaaagaattatgttaatgaaaatgaaatgtaattgaatattgcattaaataaattaactctgggttagtttaaaattatgtatgatttgagacacagcaacaactgtgctgcattat

SEQ ID NO: 1667 - DNA, 500 bp, Ctenocephalides felis
actatactttgacaaatagtttatcatgtaatntactagattaggatttcaaataatttataaactggatatacttctactnccaatatttgaatatgatatgaatgcatgtgtgtatgtatacttattgcatattaagatgcattaacatagaattaaatctcttggtnacgtatatntaggatatcatacatactcaaaatagtgatatttacaataaaaatataattttcttaaacctatattaaaatataaataaatagtaacnacnttaaaataacctggccatnattnnnaganttgntnttccttttatnggcccntattannnnatncntttcaaanttgggnnngnnaatncnngcncnnacttttatnaananantaannttatgggcnnaanttannccnnntggcntatnngtcnantnaatattccanggngatagcatgttgggcnngcctantcagcaaattngcctanatgggcatgttntaga

SEQ ID NO: 1668 - DNA, 500 bp, Ctenocephalides felis
acatacactaagtcatatgaaatctcggcaagcgttaaaagcacaatactgtcagttcttttgaatttctaaattttaaaactttacttcgagatggacgaaaaatgttcaccatccaatgcgcctaggcaataagaaaaattccaactcttttctaacttgtttgccatcatctctcttcctttcaataagaatggaaaagttataaatttagcgtgtttttgaatatggaatagtgataaaaagtctgcattttggtgatatagtgtctttgcgtataactgcgttttgcttttgaaaaagtagttctacaagttaatagtttacattttagattgaaccggttcatcagcgtataactagtaaatcttgaataattttctgggctgaaaattttaatgtaacaaatcgacaattttttagctaaccatgaattttgaattttgaataattaaagttattttaatcgtcacgtncgcgcccactcgcttttttggcca

SEQ ID NO: 1669 - DNA, 500 bp, Ctenocephalides felis
catgtcaatagttagcatatgtattaagaatttaacataataattnaaacatcaatnaaaacaatataaataaataaataattttngtatatcaataacaaatttcttaaataactaatcacatttataaccagtccattgttccttatatttatttttcaatatatcactcgtctccaattataaaactttgactagacctgataaaatattttatacataaaaatactttgnttatatcaccaatagttaaactttaaaataatttcataatcacaagtgctatgatattaaattagaagcatttaatttatataaacatattaatagtaaatttattatgaaacttggtaaagttaataaatacacattaataaaattcttttccaatatatgcttttttcttcgaaatgcctttcgatgaatatacattctaagcttctttccaattcgtatccgtccattctatcctctgacacaaaattaatttcattcccntc

SEQ ID NO: 1670 - DNA, 500 bp, Ctenocephalides felis
ncaaacgtgaccatttttcacgtgacggtgcattgtggttttttgttattaattttgttcataaataacatttcttggatttgtcaaaaaacaattcggtgtaattgttcttatatgcaagtttcaattattttatattttgggttatataccaattaagtaaaatccactatttttttcatgtatctctaccatttattattttatatcccttgtagtaattacgcagagcaatgtaaataattcagatattatttattcattaaaacatgacagatttattctcaagataaattctcgacggagttgtatattttccactataaaagctgtaaacaatttgtaaaacattcattatttacctagaactactgctcatattctatttaaaaataaatcgtaagattatgttcatttgcataataaatattagcaaagtttatagtattataatngtaaattatttgcataaaggngtttataagtaattagttttgtga

SEQ ID NO: 1671 - DNA, 500 bp, Ctenocephalides felis
acaataaggaaaattttgcaagcgaaagtttttggataaactgaaatatcattatgttaatgtttcatacactctacaacttattgattttttttttctttttttgaaaatgatttttagagtttgagttctgaatatttcgaaaaatttagaacacttcaaaagttttgaaatattaatgatgaatgtggcatgttctgtaaataattcaacaaactaaatattttatactagattctagttggataaaaaataattcctgatttataatatcattaccaaaatttctctaaacaatttaccgtaggcaaaattttgttagaatattggtgttttttaagnaatctcaaaanggnataaattcccaaaaattcccattnttgggganttnttntcttaatnttggaanaaaaatggnggttttnttccaanatctttnaaaaggggttaattanttcccaanngggttttgngaataaanattcaaaattttgnccttt

SEQ ID NO: 1672 - DNA, 500 bp, Ctenocephalides felis
actaattgattattgttattctgcaagatatgatgttccgaattattactgttccaattaattcttttacgaagtataactcatatttatttttacactaacatacttgttactctctagacatgtttttgtttgcgttttgcgtattaattacttgtgtgttttgtttccactgaagaagagtcaaattggaactcgaaccgtatggatctaataaatgtattttaagaaacatctcttagttttctttctattcattatctggatagatgactgttaaaaagtttgtgttatctataaattaatttcttgaagggcgtaacatcaagcntagagcgggggttaggtattcnaanncanagggggaaacattatttgaaacatattggtaattttcgtatagaaagggagtatcagttcgcttattaatactaagtttggctaagaaaataaaaatcgattccgcatagcgctttatgagactttcgctcatgataaaa

SEQ ID NO: 1673 - DNA, 441 bp, Ctenocephalides felis
aaaaaactgaggtcgaagcataagtcgcgccttccactatcgcttattaattatacttttactatgtattataaatgaattgaaaatattttttatctcaaatatctaaattgttacatctatacaggcgtttatcaacatcaacagtagaatgcctttctgatcttttgtaaaacaacttatattatcaactgatttttcaaaacttttgtttttttctatctgatatgttttttgatataacatgttaatgattgatataacttcaacaataaatgacatcatatttcagagaatcagttgccacaaaaaataatttattaatattgtatgtttgtaaatttgttaagaaaagaaaagcaatatcttgaaaacatatatgtatataatattttaaaaaaaaaaagnnnnnnncnnnnanntntnnnaaanannaaaaaa

SEQ ID NO: 1674 - DNA, 262 bp, Ctenocephalides felis
actaggcaaatcaatattatccttttcgcattcagagttctgcaaaacactttccgaacgtaatttctgcatttcccaaaaaagtcttctataaaaatgtctatctgacacagtcgcaatgtgtttgcgaatttttttatcagacatatttatttatacaattttttttgacaaattacagagtcaaacaacaaacaaattacgaatatattatattctaatattgtttagaattttagtagcataagtatacgtatacagt

SEQ ID NO: 1675 - DNA, 500 bp, Ctenocephalides felis
acatttaataaaatttattgtaaggttctgtaggagaatggaaaacgatattgttaatacaataaaatacaaaatcaattttttaaatttatcatcatacaactgcaaatactaacatatattttttcaaataaaataaagttgcttttttggtctcccttaattacccttcatatgaactttatatcaaatgaacattttatatattgaagccttttatctgataatagaaaaaaactatagttcaaaagctttaggagaaagaaaatatccaatgctatgtcaaaatctttttcggaatcttacttttcaaacactttttatgcttgcatatgcactttgtgaggaactatagcaggagttgaattataaggattgtaatgcaaaatttataatttcaaatggccatagctaacactaaaatcaaatgttgatattttctaaatattttccaaagaaattcaatgacaaattttgatggttgtgtagaatatagatca

SEQ ID NO: 1676 - DNA, 500 bp, Ctenocephalides felis
acttaagaacaaaaatctggtaatcatttgtgtgaaagtgtaataggacaaatagaaatttatatcattctaagtcattcaataaatgctgctaatgaataattttcatgaataactcatcaaaactaattcagattttaatgattgaaccgttattcattaaagcaatcgttttctactaatatgaaatttgcctttcaactaaatttcctttataagttcctttgactgcaagatataaagagaaaataaatgacattataatgttttatgtattcctatgtgagccatttgcagtattcgatataatactcataaatcagtatttaaatctgagacgcctgctccatgtcataaattatgaacagttattttcctcaaatcctacacagtaattatttgatatttatatagatgatataaataaaatatctttaatttcgttttggttaatattttatggaagctgaaatcaaaaacatctgctaaaataattaatt

SEQ ID NO: 1677 - DNA, 500 bp, Ctenocephalides felis
ctggtaacgaggaaacactatttttaagagcagaagaacgcgattattcaaatttaaaagagcacaaatttataccaaagcaagatggcaaaatcatgcaagtgaagcataatggagctagtcatatatatttatatttgccagccgatactgatttgaaagatttagattcattattttctcatggagaaaagacgcttggagactgggaatcagctaccgatggatatttctgtgatttggatgaaaccaatgaagccaaatcagtttgtatttctccttcagaagatacaacaaaagtgaatcaatctgagctattagacgaattcgaaactaaatatgtcaatgaatatgtagataaaagaaaggaaaaatgtcccaagtaacataaattatattcttacaataacttaatacatatattaaaatttttgtaacagtttatgtgtatgagtttaaacaataaattattaaaaataagattttnaaaaaaaaaannn

SEQ ID NO: 1678 - DNA, 330 bp, Ctenocephalides felis
acacgtttttttctaatattttgagactttgcaaattttttaaaatatccgattttttttaaattaacgaaatattctctattttttgtaagcaatctttttataacatgtcaaaatttagtttttttgctgaaaataatgaaaaatttcggaaatttgaatttttttaactttgattttttttgaaaattttgatttttttttgaaaagttttaaaattattaaattttctgtaaatgcatttttgcacactgtcttctcaagcaaaatgtaaaatgaaatttatctaatcggatgagccgttctctcaaaaactgcataaccgtttgt

SEQ ID NO: 1679 - DNA, 500 bp, Ctenocephalides felis
actcattttatatattctcggtggataaaatataattaattatgtcgccatctaacggtgtgctttacaaataaccaaaatctggtaggggggcttttgacccgacattttgagcttttaattttattccttattattatgtaaaatatagttgttaaaaatacatggctaagacagcatcgacgtttcatttaagtttaatatacattttggtctatcgacacggatccagtcattaaaaattacagtccacgctttacaattaaatatttgcgagttcgtctaaaagtgaagccaaataaagctctacgtgaatgaaaacccgggaacctgagaagccgccattaaagcttggaagcgtcgccaggagttcactggaattggaaaactataactaaagatcacaattggaaatacaagtaaatccacaattagtctaaaaccatttcaaaattgcttagtattattgttgtaagtttagtctatgtctcggccgcgac

SEQ ID NO: 1680 - DNA, 187 bp, Ctenocephalides felis
aaattcctacaattattttcgaatgacataaaaaggattaaacagcctcgaaatgtcgctgtttgtaattcagcacactgtaaaagcctccagaaatcagacaggatggatcggaattgcttgtctgcagcaggcctcttacagtacaaagccccagaaaaccaatctggctgctatgaaaagaggt

SEQ ID NO: 1681 - DNA, 412 bp, Ctenocephalides felis
acctccaaataatgaatttgtcgttcctcctagatttaaaccagttcctgaatatcaaattcattaagcatttatgtatgactatgtaaaataaatgaatttatattttatcatttttctaattcaattataatgatgaagaataaaaaaaaattcatcttgtcaaagataacttaaaaaataattaaatataaatagatttatctaaaagcagttcgtcttatgagaatttatattgaaatgctatgttaacttgtatggccgtgttgtattttacaaaataaaacttcttacctaaagtggtgttggtagaagtgtttccaaaaccaaatgtgctagttgctggtttgttaaatgtattattaaataaagagtttgaagtagttgtttgaccaaatcctccaaaaccagt

SEQ ID NO: 1682 - DNA, 380 bp, Ctenocephalides felis
acaacaggcaccaccagagaacatggaatccgaacgcccacatttcgtccaaccaagatctgtgcgcagcatcaaggagaatccccttcgccgcgaaaaacgcgtcaagagatgcgcctgcaactgcgaatgttaaacaaaaaccccaagaaattatttacgaaagcattgataaaatcaccgctaaacggaaataatttttaattcaataaaaaatattttgttaaaacatattcggatattaacaacatgtttatttctttaattttaaactaatgcagttattaattgtataaataaaattagagatttttattaaagaatgacgaaaagtttagatcaaagtcttgtatatatgttcttttaaaactgttacacgt

SEQ ID NO: 1683 - DNA, 182 bp, Ctenocephalides felis
acaaaacaaaaattcggcccagtaagggctgaaataaaaatttacatttatccgaaattaaaatatttctaaatttaacacttctgcataaagttagtgttttagtttatgattatatgcagttatttttcccggcaattttaaattacatgtgaaaacgcctagctaaatctaactacagc

SEQ ID NO: 1684 - DNA, 500 bp, Ctenocephalides felis
gacgtgcnantttancacnannaantgggggttgaanccnacctgncncaaaccggttagagctcagatcatggnngantgangggangaacagaccanataaagcaagttctggattnganaantantttacaccaacancnacggcgcgancaattttggcggnangtnctactaanagtaangacgctgccatcccttangcggcgtaacntnntangcacacacagnggccaattttcaattatatatgcttaatnaaaagangcttgntaagctcatccggtcnncccaatgaaatatangnagctanaanaacatantcctantccaaancnatntctatacntctntaanncttnaangggtnntctcgtctnntnnangtcgacgctcatnncatnanagggnccttctatncnattgtgngaagacagcaatatttgntcnatnattantcngcttncaanggaaaaacctntgttatgctcctttggcag

SEQ ID NO: 1685 - DNA, 377 bp, Ctenocephalides felis
accaaacgttaagttactaacagaactttggaaatacctacagttaaaatcaaatttgtttcacgcgcacccatgctcagaatatcaaaaataataaatgaatttgcttctgagattaatatctttggtctgtcgatgacaaatataaaaaatcaagccagaaaaattatccttaaaagactgtcttaaatagtgatttatagtaatttgattaaatgtttaattttattagtttttatttaatgttatatatttgtagtttatattaagtgttatgtatatatacaaagctatctatgaactcttaatactctaattttctcacatattatctctttaatttataatttgtagacttcaaaatgtaactgtattgt

SEQ ID NO: 1686 - DNA, 333 bp, Ctenocephalides felis
gnncntttatcaagtagatccttattgtttttaataaataancataaaattattctacataatgtcttcanngcgcccctttgttagaagcaccgtaaatcgcatgaatgctgttcgtggacaatgtagaaacagctcctacggtcatcatggacctccagcagattatgttcctccatccatgaatgagctaccaactccacaaggatcctggcaagctaaacacgatgcccgccaaaggaaatataatgcaacccttcttgctggcgttggtgtctttactggaactctcatttttatgaaagcaacagggttcgacttccactactatcc

SEQ ID NO: 1687 - DNA, 500 bp, Ctenocephalides felis
acatttacttcttacactgtatctggaaaaaatactgatttacgctaactaattttaagcatagtggttttgttttgacttatagtataaatacatgaagcattactcaaaagggatctagtccacaggcaagattttaatttaacagattatagtaatgcgaaaagatttagatctgccataaagtaactgaaatggcgaatcaatctcgcaccaaacagtattttttcagaccgttataagtgccatcaatattatgtgcttcgtaatcgcataataaatctcgagatagaccagatggctccacttagacgaatttatacgagattctaaataatttattgtctatcaacctaatcatatataaagttaataacccaattcagttttctgttaactgtggcaaatgtttgttttagggaccacacctaaccaaggaattcggttgagaaatccacacgttcttggtatatctgtggcatcaaaaatgaaatatttta

SEQ ID NO: 1688 - DNA, 500 bp, Ctenocephalides felis
actaacattgttgttgattgtttctatatgtgactaactattggttgagattaaaaactaatgaactgacttctctccttttaacttcccgtagggtaagttatagtaatcgcaaaaaaaattttttatatttcacgtttcagaggtttctaaacattttgaaacgtaaagatatataaaaattttcattttcgatttttttttttgcgattactataacttgccctatgggaagttggaaaaattaagctatgtatatacatttttgaaattgattcacgatttttggacaattttacacttttctgataattataaaaaaaaccgctcgcctgatcgttgcgcaaaactaataaacgctaactcactaagttaaatagaatggttttagtttttttcagtagaaaggagaaaacttgcttaactacactattttctaaatttggacttattcgattcagaatgacttgaacgttgatgaaacctaatattagcccatc

SEQ ID NO: 1689 - DNA, 500 bp, Ctenocephalides felis
accgccacatgagcactaagggagcgccaattaatcacgtgatcgatttttttaaggatttttaaacctttgcccttggtgatacgtggtgatatccaaaaattttctgatatttttcacttgtgaatttagactgntgaaaaatttaaaagtttactattgtttcatcatatcataaaaaattattatctcgctcttcaataaaacatggatttaaaaattgaaatagaagatccaagttaaatgttgcattatcattatttaatccagcaataaatatatctgcaccaaaatttgcctcaatacaatttgtattagttgcaataaaaaccatccttataaatttcaaaaatcactttaataatatcgattactaacgattattatttttaatctcttaatcataggattaaaaggncacgtagccggagtcacatgcatcgccaactaccggattagtaatagatcacatagaattagaaagaacggccatttagaag

SEQ ID NO: 1690 - DNA, 110 bp, Ctenocephalides felis
acaaactttgtaaaaatttagttaataagttacttgtaagccatttatttataacattcaaaacatctcgtaagcaacattttaatgggaaaattattttaccctcacgg

SEQ ID NO: 1691 - DNA, 500 bp, Ctenocephalides felis
acgagtattataatattttgaatttattaacgcagcaatcttgacccaattatctggtaaaattatactcttttctctttgaaaatatactgtttgtatttcaaaaaagtatgcatttcacacattttatgagtagttgtgtgaaacaattggatttcaaattattttaacttaaaaggctaataattatatattatttgatatcaatattaagctgtagtgatatccattttcacttgatagattacaatgtaatttcaagtaaaaatattctaaaaaaggacccatttattataatatgttattagtgttagaaaaaaactgaaaaatagatcaaatatagataaaacaaccggattgcctcctaaaaagtcacgttgttaagtcacttgcttacatttttagctcatagaattctcatgttctgattgatgttcaaaaaattcaacggtttctccgtagatcagtggtagagctttgggattcaatctaaatccaag

SEQ ID NO: 1692 - DNA, 351 bp, Ctenocephalides felis
ncgcgttgtatttcacactagatcttgcctgccgagcatgtttttattttttacaaccaacagtagnttatatgatagatgcaaatattgaattaaacaaaaatcaaagccatagttaggttacatcctaaaaaaaattttggtaaaagataatacaaaatatcttagaattcaatccgagtcattgaagcatttattattgattagcaaaaaaatatgaaataattaataaatattccaaatcaaatattagaatctatctatatttgatatcaaacacaataatactttacaagtatgttcatatcagttttaacttatagaattttgataggaaaaatcttaagaagt

SEQ ID NO: 1693 - DNA, 500 bp, Ctenocephalides felis
acnnagtagtattgaagatcttttgncctctggtgattnttcattgactatacagngtncanncttgtttaatatctgaannataaanatanatatatataattatcagaggtatttatattaataatatatacctntgaaattatttcagttcccatagaactccctaatttattataaagctcgccgagatttgaaaatgctgatgatcgaaccaaaaaatcctcatcatgtgtgccactcagaaaagtattaagaaatactgttttatacttttggacaattgatttttctggaaaataagataattataaaaatccatctctaatattttagcaactgaattaagcacctgcattaaatattaattttactaatgcttcaccaacttttaatcttagctcttcttttccatccttctgaaatttatcatgtcgattatttaaatattcttgtgtcagcaattcaattcatcttctggcatactttggaaacttctg

SEQ ID NO: 1694 - DNA, 549 bp, Ctenocephalides felis
attagctgtagcagcattgcttgagttttgagttgataacctgcaacctagcctgcgacttctgttctattgataaaggagaaataattattttatgtccaaattacagggtgataaaacccattgacgtcaatttgaaaaaaaattcaataaaaaaacaatggacaggaggatgatatattaatagaatgtgcctttatatcaataatttcgaccacaaacactgccttttatgaattaaaatgtctttaaaagaatgtgaaagtgatataaaacatttaaaatcagaatctatgttatttgcatgtgaagaaaattccaaagaaaacagtgcaaactatttaaatggaaaacaaccaatcaagaatgtgagtaataaaatattaaaaaactgtcaaaatgtgacagctccattgagggaaatataaaaaatagcagcgatattgcacgaaaacgatggaagatattagcaaaagccctaaataaaccggcacangcatcaatggaagatatttctgtgcgtagattcacaccttcgtgtattaaatc

SEQ ID NO: 1695 - DNA, 549 bp, Ctenocephalides felis
gcgcgaacaacaacagttcagtgcgaattgataaagttatcagcaaaaaataataaaataacagtaataatacttgtcgataattttaaacttgtgcatttattactagtttatttccagaagtagaaataagttggctcgactattggaggaggtttatttactcataaaacgtaaagaaattaacatgtaattacaggtcacaaatatataattagcaaatacgtaatttagctagagtcattcgtgcgtaaactacagcaccgatcatttcaaaggaaatcattgggaaatttttacaatgtggataccgttgttttttattttaaatatcgcgttggtatacgcaggaaaattcgaagaaatctatgcttggaaagacgtagattttgtgtggccttctaatgaaataaaagaagaatatattaaaaatggtcatacatcaaggaaaataatcttatcttgggaatggccaggtggcaagataagtttttctcacaattccagatggaaaagtggagtacctcacattggctatatccacttaat

SEQ ID NO: 1696 - DNA, 549 bp, Ctenocephalides felis
gaggagtcggtcctttagcctggggtacagaaacacatcgaaaaccgcagacgcttccaccaaatctgagtccaaaattcttccatagatcgccaagagaagcattgagaagagtcactagtctattgatcaggaaaggggcagctggtggaggcacgccccgtgactcgcgtaaagaacgcgagggcagcgtgttcccgatgccgcttggacaaacggtgcatagggaagctttagaggaagtggtgcctaaacaaagaagaggatttttgaaaaacttttttaagaaatctaaacattactcactggaccagtaaataatcgaaaagttgacaatttaccgagttctatgttttttaggcataagataatatgtacactgccctcaactttagtcctaaccataatattagcattgaatactactgtagttacccgttttaggttgtaggattatttatttattctaataatgaattacaattaaccgtctgcatatggaacgaaggggaagtaagacagtttgcaataaaatagtgcctgagaaat

SEQ ID NO: 1697 - DNA, 549 bp, Ctenocephalides felis
aattgatgaagcacatgacaactctagctcttctggtgattgcattttgatagaggatgatcctattgcagatactggaaataaccaatatcttaagtttgggaaagatattgaattaatacgtatgggtgaatcaatggcacagaatgtcgtgtctcctactgttacaactcctaacngaggaaccatgccaaggaaacgaggaagaccaagaaaagatgctaacttaattgcgcaaaagaaagaacaacttgctcaagaaatgctacaaaacagtctctttccagcacagcatatgcttgaaggtctaatgactggatctggtgaaagcccagttagaacaagtcgtagaagtaccagaggacgatcatcagtgggtaaaggaggtatgatttctaccacaccaagggggcgtggcagaggccgtggctctaaacagcaagctcttcaggtttcaatggaacagcagaggattcaacanatgctgaatatccaggacaaatcattcagcagcaagcttcgggtgataatgccaggtgcatgaaaagt

SEQ ID NO: 1698 - DNA, 549 bp, Ctenocephalides felis
ccgtaaattcatattctaaacgcacttgcgaatacttttattcgacattgtaacgttgactatgcttattctgtgagaattttcatgttttccaaaaattttcacaaaactgaaagagtgctcccgtaaattcacattctaaacacatttgcgaatacttttatgcgactttgtcacttagactgtgcttatcctgggcgaattttcatgttttccaaaaatttgcacaaaagtgaaaaagtgcttcagttcagtcacattctaaacgcatgtgtgaacacatttgtacgacgttttcaaaaaattttcacaaaattgaaaaaagtgttcccgtaaattcacattctaaacgcatttgctaatacttttatgctactttgtcacttagactgtgcttatcctgggtattttttcacattttcaccagaaaaaaatgtttcgcttcacacatacttggaaaaatgctcttgtaaatcagattggtatttggtcttttggaggtgggattggtgnaaacgctgacctacacaatcgtgctacaactcatat

SEQ ID NO: 1699 - DNA, 549 bp, Ctenocephalides felis
atttggtcggtgtacgatgcctccgaagcgtctttgaagtggtcaatgttcatggggctcaactgttcctataggctcaccggccagtttgccttacgatcagtaatgaactagaatcactttaaataccttcgcatcaaacaatttttaaatagtacgtaatttacaattgtaaacaaaattgtcattgtatatacttatatgtgtatatgtatacacatatatttatatagttatttatacatattatatataatatatatgaatatgtatatatggtgttatcgataaaattaattttcactaacacattgttaggttttttaatatgttttaaacttcatttcgcaattttatataaatatgatagataaaatgttgtcacgataatagttgatttgaatatatatgtagatagagaatgcaatcatttggatgatatatttcccaaagtgcaatgtttattgctaagatatatttacataggtcatgtatctagtcatgtattcaagttactattcgtgnaatgaataatcagagtatttggta

SEQ ID NO: 1700 - DNA, 549 bp, Ctenocephalides felis
atcgacttaataagatncctacgaaagtggaattgattaagaaacgnaggtccttaataaaagacataggaccttaataagagatacaggcccttaataagagatatagaccctttgatgagacgcagtcgacgcagtacctctgccaacccttaggaaagacggtggagtcgctggtgtgggatatagtgtgttcgtgaattttgtgcaaaggaatagtgaaataagagatttgtttagtgaatattgtaacactggttgttctactgttgctgttttattatttagtgaagaggaaagccaaaacaatggtttcgtcccagaaagtccctttgggcagttgctgccgttgctacactctacggacgggcaccatcttcagtggtgtaatgggaatattattggcggtggtcgcttaatattgatgtttgcacttcggcgagttcaagacaataaccatagtcagtctgcatcgtggatcgtaaagatatattaccattaatctacctgactgtctcatatcggtatgttgatataggagccgtaagc

SEQ ID NO: 1701 - DNA, 549 bp, Ctenocephalides felis
gcggtaacgtcattcattgcaacattaatatgggtgttcgtttacctgctgggaattcgagaggtgctacaacttcccatcaactggctgttgacggagctggttaacactggcatcatcaccgtgctatatacgatcgctttcattgtgcagttagcgaaatgggtcccgggttggctggttcattcgtcgcatcaaacattacggcgggagtttttggaattttcaatgcattggcgtatgctgccggagtttactttttgcacttggaatggaaaagcagcggcggtgcatctacgaactagtcctggttattatagttcatttactcaacaccggctgttgtattcatatcaactatttaggataaaattcttattatatttatcgccaaacagtttgtatgtataagtacaaacaattcgttgaagaattatgtcgaaataacgaatataaaatttatatttttctaaatgtttctatatgaatggttttatataaaaattgatacaatatttcataatacctgatgaattatatagctggata

SEQ ID NO: 1702 - DNA, 549 bp, Ctenocephalides felis
aataacgctgttgcnnttnctggaactgtactggcagcaaagcganccggcgcggcggacagtgggttggctgcgaatgttaaaacgtctgcgcaaagcgcgggaaccacggcctttacgcttaagtccattgcatatggatgtccacgccggaaatttagtgcatagcgcgtcagggttaaaactcatcgactgggagtatgccggagatggtgatatcgcgctggaactggcggcggtgtgggtggaaaatactgaacagcaccggcaattggtcaatgactatgccactcgcgcgaagatttatccggcgcaattatggcgtcaggtcaggcgatggtttccctggctgctgatgctcaaagcagggtggtttgagtaccgctggcgacaaaccggcgatcaacaatttatcaggctggccgatgacacctggcggcagctattaatttcccgcagacatgacccttttagcactcggtatcaaccataaaacggacctgtatcgtggaggggggnccggtcccaattcgcctatagtgagtcgat

SEQ ID NO: 1703 - DNA, 549 bp, Ctenocephalides felis
gctatacccaccactagaacctgatcctgtctttagacggagagtttttgggcctgattctattttaaacggaacacccaaagataaagtagatagagtacggggaaatgattcaaaattagttataacggcaatccaaggtttggtagcagatgttgatcaaacaagagctgctgtacaaaaccaacatattgaagattcaacacgaaatactagtgtagaggaccatgtgcatttaaatgggaatattaagaccagtgacttagttaaatcgaaaacatcagacccgactattaattcaaaagttcatggagaagtagaacataataaaaatttcacacaattggatcaggaaattgaagacaaacctacagttaagattttgggcatggagatgactacgcagtgcgaaggtggcagaaatttagtcaaccaagttcaccaattctttatcagctccaagaccagaacaattgtgccatcaatatatttggaggacttcccataatccagttttggtcagaattgaccacacagaattctccgttc

SEQ ID NO: 1704 - DNA, 549 bp, Ctenocephalides felis
agaatcagctgtcacttatcttggttacattattctgtatattttcaagatgcttcaatataaatattatgatacgccagatggccaagatttaataaaaaaattatttataactggaaaatatgctactttaactggcttaggcatctcatcattagatgtgcttctttattcaaagcctaaagggtatttggaagcattaggaagatatgcaacagttacggggcctcttgtgggaatggctgctgtttttacaattggtacctatgtagctaccaatgttcgtgaaaaagatgactataagaattatgtagttggggccacttcagctggttgtctatggggcgctttacgcagaagctatattacagcagtattcagttctttagcgttttcactagctggtgttatcaagaaaaaggcaatagagaatgattatacattatttcctcacctaagagacattttgtggtcattgtggagccaaaagccgatttactatcttaaaagacgccaagggtggcccaggggaaaatgataacataaatt

SEQ ID NO: 1705 - DNA, 549 bp, Ctenocephalides felis
agattcttagtgcgatataggatataacatcacaattagtgaaattgatttgaagggaaaaatgtcggaaacgagcgagggcgtccatccgttggtatggtccgcgggtttcattgcctttaccctcttgttggcgcaagtatgccgcatggccgcctccaggacgcagcgcggaatgatccgatccttgattttggaaggaatcgccgccgctgaactttgtgcttcctgcttcgaattgatcatagttgccgacaactacggtgtatctatgtacgctattttcctgttcgtcctgacgatatggtggtccatggtttggggcgatgccactgcctgcccgtatacgcttctggaagatgtcgtggaagacaaagctacattgcgcgaagctgactgaaaacttgggcacaactagttggcggtgtctgatatttcgtatgtcaattattttggtatttggagcttctcaacgcatacaggaagagcatttgaaaactgacggtgatttacaggtatctctatgctaggaacgnaatagaagattgc

SEQ ID NO: 1706 - DNA, 549 bp, Ctenocephalides felis
gagagagagagagactgttcgaggaagcaatgaaaagtccacttaacgccgaacctgtaaataaatcattccatcagtatttgaagccgtttttgcaatccaatctgtgaaaagaaaatattctacatttttctagataaagtggaatgaattgaaaatattaaggagtgcacgtgttttgttttgcgaaatgctatattatctgtccatttatacacaagtattcagagattaaaaaatcaattacttaaatcttattttgaatgccacatatttattacaaagggcttcaactataaatttattttagatatatacttatcaggatatacctgataattatgtctcttttctgagcatataatgatgcattcacaaaacaattttgaacaaaattagaaaaatgatataaaatgtaaatgacctattcctaaatcattgcttcatattatttcgcctccatttttttccagcggtttattatagtaatatgatttgtgaggaatttatcttaaggagcatttgtaatgaattagaagtgttagatca

SEQ ID NO: 1707 - DNA, 549 bp, Ctenocephalides felis
gagagagagagagagagaactagtctcgagttttttatgtcgcgtttttgtatgtgctataatttacatgttgattattgaatcttggtcttccatttatttgaaaataaaattcatatcttagttatttaataataataacctcaaagtttatgacagccagtttcataacattgctagtggtagagattattagttaggttttatcagatagtgcacctcttaataatctgacagcagaaaaaataacaaaatatgtcagattcgatgtcacttcattccacatcggcaaaattgattgtggaaaatcctttatgggagcaaaatacgttcgttggtcggttccgtcacttcttatggatgaccgattggcgatcctgttttgcttcagaacgtgatctcgataaagcagaagagttgataaaaaaatgcaaacgcggtgaaggatgcggtgatgcgcaaggtgcgacttgattacccaagagctatatgaatcaccttccccggcactggagaaaacaaatctttcgaccatgtattcagtgcccg

SEQ ID NO: 1708 - DNA, 549 bp, Ctenocephalides felis
ataaaatgacaactctcttgataatcgcgtcgcaaaaaaacatttatcctttcaaaccgatcacaaaaacacctaaattaaccagcattgtgaataaagtgtaagaaccgacacaagactattaatacaatgaccagtgtcaatctgacaagaagatgtgtcctgtttgggtggaagcattttgccaaaacaagaaccaacagcctcatatactcttcccagagacaacttattacacctgtgccccagatatctgtgttgtcttcaagttttatcaaaagcagattctattcgacacagaaaaatgaacagagtgctatgaaaccagacgatgatgattctacggataaagacaaggataaggaagctgttaagaaggaggaggatgttaagaaaatgggtttgttaagaagtttaaacaaatgtacagggattctggatgtgctgatccggtgcatgttgcncttctacgtgctgggctgnctatttactcccgcaaaagtggtgtggtgtgatagcatcctggatcgtcaagcagtctgactatcg

SEQ ID NO: 1709 - DNA, 549 bp, Ctenocephalides felis
cttgaataacacatcacacaaaaataaaattatctagtactaaatattctattttgtttatcaaaatgtttaacataactcatataaacactataacaacccaagaattttgcgaaaaattcaacaatgtcatagaacactacccgggggctgctgaagacatggctaagcaaagacctttcggaaacaccgaagatttgatacagaaatttagtgattatttggaaaatttaccaaaaacagaaaaagagctgattttaaaactgcatccagatttagctggaagattgcttgatactggcaatctgacacctgagtcgcagaaggagcaggaggcggcaggtttgcacaaattgtctcaagaggaaaaacagttgatgaccgacttgaatttagagtacaaaaagaaatttggtttccctttgtcattgtagctcgtgaaaacaaagctgcagcaatcttaaacggctaaaacacgtttactaaatacaagagaccaagactctctgccggataataagtcaaagctatcagattggaatcttactt

SEQ ID NO: 1710 - DNA, 549 bp, Ctenocephalides felis
aatnnaaagtgaacattatatacattgttggttacttagatccaagttataaataaatattaaaattcgacaaatattattcaccaaaatatattgattgcaaatacaaacgcagatttattatcaaattataatagcatctcttacgtactgtgtgtttcccagttctaatcagtgttttcgtgtttcaagtttggataaaataaaaatggccgataaagtaccagacaccaaccaatgcgccttgtcacagaaaaaagtcgaaggggccaaaagcaacccttctttgctgccccatttggagtctttggaacgcatgatgaaactgcctgtggtagaagcggcctgggcccaatctcagggcgtttatgataaagttaaaggttacaacccgatgctgacatgggcatttggaacagcgaaagcacagtcaattggcctggcaacagcttcccttacatccagaaaattncaaaccaatccactatgtcgatgagacctcgcaaaggatcacaattagaagctagttcatcgcangacacctagnga

SEQ ID NO: 1711 - DNA, 549 bp, Ctenocephalides felis
aagaactcactattgtttatcattccatgtgtattttcatatattctagaagtntaaattattctaaagcaaatgcttaaatatttggaaaatatattgctatgtgtttttatatgagttcatttgatatatgaagtatcggagcatgttttatttgtgttttatttatcatcgtatatctaattgtttatttaactgaaatgtgtttaaaaaatattatataattcttacttatttatgataaaaattcaatttccatttaattataagattctttgacaggttttaagactgttgattcgttttaaccacatttagagcaagagttaaggttaacataatcagtataatatttcaataatgtgacaatgagtaatatttgtactattgtaattgtactgataacacaaatctctaacatataaaacatattcatttttcttcaaacataactaaatcgcatttttgattatttgacatatatatatatacatcatcatcntacatatatatatatatatatatatatatattatatataaaaatatg

SEQ ID NO: 1712 - DNA, 549 bp, Ctenocephalides felis
gttttagtgctcaagtgctccaaggtaattagccagcnggtgaagaaatagtgagtaaatatcaatcaaagtgttttttattaatactgttgaacatcaaaatgagtgtaaaaattgaaaatattgaatcggaaaatccaaaaataatacaaccgcagtacagcgtccaaaatgtctgcccgcttcaaacaagcgctactgaagcgcctctatcaggagaaaaaggaaatgatagtgatagaaaagaagcaaaccaagtgggtgcaacaaatgggaagaagaaaaaacatagacgaggtaaatgtaagagaaaacctaataaaccgtacaataaaacagcctggacccaacgtaagaatgtccaaaaagaaatgatgagagttcgtagtgcccgtgctaaaatattagccatggggcacacattagttccttgtaacacgaaccaatttctcatggaagatcatgatgtcctcaccaaggattcatctgcagactcggactctacttagtgtcgttctgaagacactctnatgtcttcctgagatgagn

SEQ ID NO: 1713 - DNA, 506 bp, Ctenocephalides felis
gtnttagagaggttatttaagattgttatattttcataaatatctcggacatggctactaagtttattgtaaaatgtggtattgccgggggcatagtttatcaatcagttgaccaaggactatggggtagcagttctagaacaattgaactttatgaagatttatctaaactcgtggaaccagtaaccaaagaagttaagcaaaagattgagcttccagatttgcctacatctggtgaagttggtttcattgcaacttattattggaatgcaggtgtgaaagctacatttgcatttttaaaagaatttccaacgaatactgctcgattgggatgcaaatcttataattatattgtaaatcatcctgaaataaaaaaattgcaggagcaaacagaaacaaaaacagaaaagaattgatatgtatatagaaaaaaatcatgattatggattatgtagataatatttaataataaatgctatacatcttaaaaaaaaaaaaaaaaaaaa

SEQ ID NO: 1714 - DNA, 549 bp, Ctenocephalides felis
gagttttttttttttttttttgaaaaatatacactaagtaattacatttatattcaatttacatttgtacatcattgtaattgactacgaattaacagcaatgataaaatactttatatatgtatatatatatatatttgaaaatctgtgtaaaacccgttacaaaaatantatacangacaaaaaaaatattacatcatggcaacctcgactgtccatctntcaattaaaatctacactatcttttgtttgttattaacattttcctattggatttaattattaatttaaatgctttcaatgattcaattagcggaatcattttgctttggatatcttttcacatatctcgtttgtgaattctgaacacttagcgttgctcctaaatcacctgttaggtatttggcttcacggattgctcgaaggctgctgtttaattaagtctgcgtgtttgaaggtcatgtgctcagcatcattcggaggatacaagagggcagtggggttgctttgcttgccgcttgctgggtgncgtgccagatcaaangcgct

SEQ ID NO: 1715 - DNA, 549 bp, Ctenocephalides felis
aantntcgtctgtgaatattaggaaaaaggcgggttttaaagaatttgcaattgatattaagtggttttttatttaattagtttaagtgttatataagtgcaaaatcatgacgttaatagtgaaatggctcagttcttttctgctgatcgcatccttggcattagcacaagtgacccccaaggaccccgcctgcatanaaggcttcgatggcaacatccacgccctggacgcggctgaattggacttctctttacgaatgttagctgctgcagttcgatctgcacctggtcaaagtgtatttttttcaccttacagcatttatcaagctttgctcttagcgtatttctctagtgctaaccataccgaagctaacttgaagaaaacattagctatcgaggaacatgtgccaaaactacaagttctgcatggatataactttgtgagaaaaatgcttggatatagaacgaatcaatcatatgaatcaatntgctgtcgcttttgtactaagatgaccanttnggattgattcaagctgcatgagagacaaa

SEQ ID NO: 1716 - DNA, 549 bp, Ctenocephalides felis
attcnatgatacaattttgtataaattagaatggccaggaagaactgacgaatttttagaacctccaggtagtgagtctatgttcatcacaacagctgataaagaacgatatcaatgttttgttcctaaaatctcaacaccagagtctgaaaaaaatttaccatatagtggaccaactgcgttagaattattggcacctttattcacacaaactgcttgttcatatcgtgttgaaagctattggacatataagctttgccatgggcggtatgtgcaacaatatcatgaagaacgagaagggaaaaaggtgaaaactcaagaatactttttgggaaagtggtctgctgaaaggcatgatgaattattggctgaaatttcaaaagcagaaaaaagctcagaacctttgcgaaccacaaaaattgaatcagcagtttgcttttgtagaagtagttatgacagaaggtctttatgtgatttaaataataaaaaacgagttacaagagttctgatgttgtatgcaatggaaacatgaaattattcctaaagaaa

SEQ ID NO: 1717 - DNA, 549 bp, Ctenocephalides felis
aataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcttttgttgccagcggtccggcgggaactcaaaggagactgcagtgataaactggaggaaggtggggatgacgtcaagtcatcatggccttacaccagggctcacactgctacaatggcgcatcaaagagggggnccgtcccaat

SEQ ID NO: 1718 - DNA, 549 bp, Ctenocephalides felis
taacgttactaacaaatcgtcatctacttgtaattattaagtaatacttcataattaagtcctgaaaacaaccagggcagcgggtttaaataaattgtcctcaacattttttcttaaaatagaggcgttttgtatgccaaatattcatgaatatgtacttatttcaagtttcgtttttagaaatactatttaggtattgtaatagcatggactatcattccaaaatccatatctatttttataattgtttttgtagaatgatattaggagagacttatatgaatgattttgaacaataatggttgaaataaactattcaatcttattactttttacatatatgtatttatttacatataaatacatatttgatttcaatttgattcaattgtttgttgaattttttgttgatagatctttttgcagtgttttctcgtaagttaattcaaatatatgcgggcataagtaattcaatagaatatttttctgtatacttctatcgtattcattgaatatattaattgnaaagngctatttatatcggtaaaa

SEQ ID NO: 1719 - DNA, 549 bp, Ctenocephalides felis
agaacagattttcaaagacgccaatgacagtattacacttttggctcccaatgatgaagtctttgaatcattgactgaagaagatcttaatgtattgttggaggataaagacgccgctagtgagacattgaaaatgcatgtacttccagagattttatgctgcaccggaaattggccataacgtatggccattcttggaatctgtccgatctttgacaaggccattaaatatcaaccgtgatccaaataccgatgaagtgtatattggaaccacaactgtcgcccaatgtgatgtaatgaatattaatggagtcatacacagagtcgacaaggtaatgttacctcaacgacctaaagtaagaatgcctttcttccgtcaattcatgttttactaagcactgattaagcgtgaatatatattttcatataccaaataaagccattagtttgaattttcgatatttgtaaaatgagatgattgaaatatttcattaggacgctaaatctaattgagtattgtattaattaaaaatttataattaattatag

SEQ ID NO: 1720 - DNA, 549 bp, Ctenocephalides felis
ataaaaaataagagaaaatggtcgtttgtagagttatatcattatcttgtcgccgtttacatgcacctgccaaatttttgaacccacttttgaattcacaaaatcaattggcaaggacgagtattaaatatatttctacatcacagattaactttgcagaacgtaagtacacagataaacatgaatgggttgttgtcgaaggcaatgtagggactgtaggaatctcaaaatatgctcaggaagccctcggagatgttgtttatgcccagctccctgatgcaggtacagatctttctcaaaaggatgaatgcggagcattagaaagtgtaaaggcagcatcagaattatattctcctgtttcgggcaaagttactgaaaaaaactcagctgtagaaaattcaccagctttgattaacacatcatgctatgatcaggttttgttacaggntggtattcaaagtaaatctgcgaagcctgaaaggtgaataaattgatgagtgagaaaagtatgagagttttgaagannacccattaaattggncattaaan

SEQ ID NO: 1721 - DNA, 549 bp, Ctenocephalides felis
aaaccatacctagtccaatttggcatttagaaacaattgcaaaatataaaaactaaataaaaaatgggtgtttacgatttgttattcaggaggacttccacatttgtagccactattatggcctcgacgttctttttcgaaagaacgttcgaattaggttctgaatacatgttcaacaaagttaatgaagggaaactgtgggcgcacatcaaacataaatatgaataaacaacaactcaaattggataaagtagagtttattatataagctagacaaataaatttttattctgttacttcccaaggcttttctggtctgtcagcgtcccatggttgagccttcttgaatcttgctggttcattgagtgcaacaccacctgaaaaatcaattatgtaataaaaagtgtaaaatataatatagtagtaacagaaaaaaaaaaaaaaaaaaaaaaaactcgaggggggcccggacccaattcccctataggagccgattacaatcactgggccgcgtttacacgcggactggaaaccctgcgtacccactaa

SEQ ID NO: 1722 - DNA, 549 bp, Ctenocephalides felis
atttatttagtaactttaattagtgtacagtattagcaaacaaaatatgatgaacattcaaaaaatcgttaggagcttaaaccgagctggagttgcaagaatgtcaactggacagtacggtgatggtgctggcaaaggaggtggtggtggtggatccatccgtgaagcaggtggatctttcggcagaatggaagctgctagagaagaagaattcttttataaacagcaacaagcccaattgaagaaacttaaggaacaagcaatagatcagaaaactttccatgaggaacaattaaaacttcacaaggaggctttggagagacatgaaaaacatttggctgagcttaagaagtaaattgaagtttcatatatagcattatgaaaatgttagacagtgataaaaattcaaatatttgttactatttactgaattaataaacttgcattaaagcttctataagttattagttttctagcattcttaatatactcattgcactacattagttttaaattctggtntatnatgtatgnactagatttgnaata

SEQ ID NO: 1723 - DNA, 549 bp, Ctenocephalides felis
aatctgcttaatgcgcgcaaacacctctgtcagctcgctgacattccccgccagacgctgattttccagctcagcagtcgctttacttctgctaacataaccgggatcgcggcgagacagggtaaactccgccagaccaatcggatttgaacgataagaagaggtttcaccggaaggaatcagttcgtcggtggtggtcacttcgtcgaggatcttcgagcacactttcaggacgatattgtcagtcagcgcacccaattccggccagtctttaatgttcggcccgtaaatcagcggttgctgagttgcccctttcacaaagccctgataaacacggtttttatacggcgttacatcgaaggcgtactccggcacgttgtcccagcaatcaagttcgctggcagaggttaaatagccaccgtttgcgcagtcgcagcgatagaacgagcgtcatcaacgccaccgctgacatctgccattagctggcttagagccttcgcggtcggaagttncgcgtgggtggcggatctcacgcagcggacagcgttg

SEQ ID NO: 1724 - DNA, 549 bp, Ctenocephalides felis
gtcagacggagacgtgctccaaacgctcttataaaagaaattgttaaatctattgaaatccttattcatcggtgcctattttcggcttaaatatggttcaaaagaagcctaagaagaaggtcggaaagaaagtggcagccgcccctttggctgtgaagaagtctgaacccaaaaagttggtgaatcctttgttcgagaagagaacaaggaactttggaatcggtcaggatatccagccaaccagagacttatccagatgcgtgagatggcccaaatacatcagaatccaacgccaaaagagcgttttgcagaagcgtttgaaggtccctccaccaatcaaccagttcacgcagactttggataaacaaacagctacacggttgttcaagattttagaaaagtacaggccggagactgtattgctaagaaggnacgtttgcaacacgtgctgaagctaaagccagggcaaagaagacacacccacgaacgtncaatgttgcgttccggcacaacactgcacaaantgtgacaaaagaagnacagnttgcg

SEQ ID NO: 1725 - DNA, 549 bp, Ctenocephalides felis
ctttgggggtaagcggggttcctgtaccaaaagattcatcagtccgcatcaagtgtccgggttgccaagttcgacccgtgttccattccaatctttctagccagactcacaaaaaactacaaccatggctgacgatgaggagaagaagaagaagcaggcggaaatcgaccgcaagcgtgctgaggtgcgcaagcgtatggaggaggcctccaaggctaacaaggccaagaaaggtttcatgaccccagacaggaagaagaaacttaggttgcttctgcgtaaaaaggctgctgaggaattgaagaaagaacaagaacgtaaagccgccgagaggaggcgcatcattgaagaacgttgcggtaaaccaaagaacgtcgatgatgccaacgaagaggcggttaagaaagttctgcgcgattatcaccaacgtatctgtccttggaagattccaaatatgatattggatctcgtaaacgcaaggccttcgagattgccgtctcaactcacaggtgaacgacctagangaaaattatgaacccccctcaagaa

SEQ ID NO: 1726 - DNA, 549 bp, Ctenocephalides felis
aattcggcttcctgctngacgctctgaaatacggtactccgccgcacgcaggtctggcattcggtcttgaccgtctgaccatgctgctgaccggcaccgacaatatccgtgacgttatcgccttcccgaaaaccacggcggcagcgtgtctgatgactgaagcaccgagctttgctaacccgactgcactggctgagctgagcattcaggttgtgaagaaggctgagaataactgatatgactcaaatacacgaaatcattcgcgttgcatcgaggcggcaactgagtgaactcccatgagcatagataactatgtgaatgggatgagcgaaggcagtcaacgaagaggcagcgtgaaggataaagtgtataagcgtcccgtttcgatcttagtggtcatctacgcacaagatacgaaacgggtgctgatgttgcagcggcgtgacgatcccgatttctggcancggtaaccggcagcgtggaaaagggtgaaaccgcgccgcaagctgcatgcgcgaagtaaaggaagagtaccantgtgttgcgctg

SEQ ID NO: 1727 - DNA, 549 bp, Ctenocephalides felis
acgagtcatgtgcttccggatggctgacgacctacagcttccgatgtcagccagtcgattattcgaggtcgcccgaagccatgcggatggtgcatggctgttggtggtactacttctcgaagttcacggagtttttcgatacgattttcttcgttttgcgtaagaaaaacaaacatgtgtcgacactccacgttattcatcacggatgtatgccaatgtccgtctggtttggcgtcaaattcactccaggtggtcacagcaccttttttggcttcttgaatactttcgtccacattatcatgtattcttactacttgcttgccgcacttggacctcagtaccagaaatacttgtggtggaagaaatacctgactggtcttcaaatggtacaattcgtcctggttatgatccacgccttccagctgtgtcattgaatgtaattacccacgtgccttcgttggggatcggcatgcatgcagtcatgttctacttctattctctgtttctacaaacagacttacacaagaaagaaagaagagaagcgatgaa

SEQ ID NO: 1728 - DNA, 549 bp, Ctenocephalides felis
aatttcctgtgaggtgattaccctttcaagcaatattcaaacgtaactatcctttaattttcggatccagcgcatcgcgtaaaccatcgcccaacaaattgaacgccagtacggtcagaaaaatagccagggccggaaaaacagcgacatgcggcgcgataaccatatccgctcgagcctcattgagcattgctccccactctggtgtcggcggctgcgcaccgaggccgagaaatgagaggctggcggcagagataatcgaggtaccaatgcgcatggtgaaaaacaccacgatagaagagacggtcccaggcaggatatgacgcaacaaaacggtcatatcgctggcaccaatactgcgtgctgactcaataaaggtttgctgtttcaacaccagcgtgttgccgcgcaccaggcggcaaacgcggggcccggtacccaattcgccttagtgagtcgtattacaattactgccgtcgntttacaacgcgtgactgggaaaccctgcgttcccaacttaatcgcttgcanacatcccctttngcagct

SEQ ID NO: 1729 - DNA, 549 bp, Ctenocephalides felis
aatactctgcgcttcgtcataggcttcaatacgcgccgccagctgctgcgaagagagcgccttacgcaatacgctgtcgaatttcggatcgcaccagtgggcgaggttggtctgcgaatgaattgccgcgcagctcagtaacggacggaagaaactgtccgggtcgttactgtccgtcgcccaaccggataacgtcagatcatggctcatatccatcaaccgcgcctcctgaaagcgaccttctaccggcacaatcaccacttttacgccaacctgcgccatatccgcctgaatcagttcggcagttttcagtggactggggttccacgcctgcgaacgtgtgggggcccggtacccaattcgcctatagtgagtcgtattacaattcactggccgtcgttttacaacgtcgtgactgggaaaaccctggcgttacccaacttaatcgcttgcagcacatccccctttcgcagctggcgtaatagcgaagagcccgaccgatcgccttccaacagttgcgcagctgaatgggaatggcaattgtagcgt

SEQ ID NO: 1730 - DNA, 549 bp, Ctenocephalides felis
gaaagggatggcgtcttatgccctaatatggcctgtttccagtattatacaacagacaatggaaggaaaaagattagaaaattacgattggggtcgttgtttacgattcagtttatacggatgcctatttactgctcccactctgtatggttgggttcgattatcaagttcaatttggccacacaataattttaggacagctgtaactaaagccctcattgaacaagttacatatggaccattcgctcttgccagtttcttctttggaatgagcttgatggaaacacatagtgtggacgaagcagttaaagaagttaaagccaaatttttgcctacttataaagttggtgtatgcgtatggccgtactccaaacaatcaatttttctctagtaagtgaatcaaacagggtaccttttgcagttgtgcagtttgatgtggacatcattcttggcatatatgaaatataaaaatgcccgatggaatcgccagcaaacacggcaacagcctcttgggaaaacaatcaacgcctctaaccatctttgataagt

SEQ ID NO: 1731 - DNA, 549 bp, Ctenocephalides felis
aaacgcctgtaacgctggaagccttagccgaccaggtggcgatgagtccatttcatctacatcggttgtttaaagcgactaccggaatgacgcctaaagcctggcaacaggcctggcgcgctcgccgtttgcgcgantcgctggcgaaaggggagagcgtgacnacgtntnttnttaacgccgantnccngcagggngcagttctnntcnaaaattncanaannctnngcatgnnaggtananannttccnnncgggggggaaaanatgggggggngctttcgctctgtnngnttgngatcnggctcttnccctggnggcaaaangngagcggatntttgcgntatnttggtggcccgnccncantccnccttatngngagtcatatnacaatacagnggccgttttcnacagcgtgganagngaaaaaccggtgtnncccctattagcntgtngaaantcccnttttccgntngggataataaaagggccccccactgnccttttccnaattgccccccnatggggaangggaatttgagggttattt

SEQ ID NO: 1732 - DNA, 549 bp, Ctenocephalides felis
caacgcttgtggaantgcaatccaccaaatttgaatgccaacttgctccagttggagatccgaacatgaaggttgaatggttcctaaatggcaagcctttacctcacaaaaatcgtttcacgccgatatatgactttggatatgttgctatgaattttggctgggtctaccccgaggatagtggagagtatttatgcagagcaacaaatctttatggtatggatgaaactagagcgattataaaaactgctggtagaccaggaatcatatatgattcacaacttcccaaacatatgaagagcattgaaagaattagggagatggaagcagcttggcaaattgtgccggacgaacctgatgaagaatctaaacctaatgtgcacctgtgtttgttagcaaaccagaccctgccaacggaagaaggcgaatggctagattctgctgtagagtacaggtcatccacgtcctanagttatgtgggtagggtaatggtacactgagtcaacggtcaagattaaattacatatgatggnatgttcacatggnttn

SEQ ID NO: 1733 - DNA, 549 bp, Ctenocephalides felis
aagttgtcgacatgcttgcactggatgccgatgttgtatgcagatgtgcgggtggaaataatgctgggcacactgtagtggttgaaggcactgaattcgatttccatttactgcccagcgggataatcaacaaagactgtatttctattattgggaatggtgttgtcattcacttgcctgttttattgaggaattggaaaaaaatgagaagaaaggtctaagtggttgggaatctcgtcttgtaatatcagatcgggcacatcttgtattcgacatgcatcagcaggtcgacggcatgcaggaatcagaaaagggtggattaaccattggcacaaccaaaaaaggcattggtccgacatactcttctaaggcaacccgtaatggattgagagtgggtgatttattgggagattatgatttgttcagccgaaaatttaggcagtggctgctttgtccaaaaatgtttcaagtcttgaattgccgtggaagggaattgaaagnatcgcnatttgcagcaattggcaccnttgtaaggatctnatcgatttn

SEQ ID NO: 1734 - DNA, 549 bp, Ctenocephalides felis
atgatatttcacaagctttaattccatattggagaaaagactgcatgagaaatgaactgaaatcccttaagaaaacattagatgacaaagatagaatggcaaaagctgctgttatgaatgacattgttgagaaggtaaaagaattgtgcctttcaagtgaatcagatgtatttgttaaacaactgcaagcagattcaaacactaaagccttagatgctgctttaaaacaaataaaattattgaaaccagatgcatcagccatgtttttctctgttgaccaagacagtggtaaaatattctgtttagcttctgcttccaaacaagcaattcaaaaaggattaaaagcaaatgaatgggttaatcatataacaaaaatcataaatggtaaaggtggtggtaaacctgaatcagcacaagcattggtagcaatatcgcaaaaattgatgagtgttaatagctgcaaaagaatttgcagatttgaaatactgnaaaatgnttttacttctgcattgttgaaacattnactatatcttagcatttatccgtatt

SEQ ID NO: 1735 - DNA, 549 bp, Ctenocephalides felis
gcaacaacaacctcagaatttacatcaccacaatactagtcagcaacatcaccatcaacaacacagtagtaacaacaatatatccagtgctggcaacatgaatccgcaacatgtgaatagtcatctttctcaccacagtccattatcttcatccatgagccatcatcatacaatgcacacaccttcgtcgatcaattcggggtatcagcatgtgaaaaatgaacctagtgaatacgattacatgaataattgtcttcctggaagttatttcacaggaaccagttttggtactcccctgagtcattcacagagcagtgctgtagattccctgagtgggtaccatcatcaacacaatgttatccaagccgctaaattgatggcaacttcttgaaattttggtttgaaataagtaaaaatactaaagactaataaaaaatgtaaatgatatagaagtcaacatatttgactatcaaaatataatgcaaaaaaatgttgtgtgacaacattggatggcaagtagcaaggcaatatcaagcataattacataat

SEQ ID NO: 1736 - DNA, 549 bp, Ctenocephalides felis
atngaatgatggcagttactgatcctgcattatgtagaagagttgctttaagacatacctgttttttagcagctttgtcattatcagctccttttctagatgttactaattattggtttgctgctgaaacgttaccattgaacggatactttatgtacttagcttggaaattttataaagaatcggacagtaaaagttctagaaaactatttagattttcactaattcatttacctgcattgatgttattatttttattaaataaaaaggaatggttttttacgaaagactcaacattggaaacacctttggatatcgatgaacacaataaaactcaaacaataagcaataaacctgcaaaacaaacagttgttgtaccttcagctattttagataaaatgtaaataatatataacaaaaaatgttttagtaaaaaatagaacaattaaagatattatgagaacaaaaaaaaaaaaaaaaaacctcgnggggggcccggacccaatcgcctataggagcgatacattcctggncgngtttacaccgcgg

SEQ ID NO: 1737 - DNA, 549 bp, Ctenocephalides felis
aaattttcttttaataagaaaaatttattattaagtttattaattttagaatataaagctttaattatatttttaattttatatttttgttttaattatataatatttgagaattatttttgtaatttttatattgtatttacagtatgtgaaggggttttaggcctttctattttagttgcaataattccgtactcatggtaatgattattttaaaagatttaatataatacaatgttaaaatttttaataataatattttttataatccctattattttattaaaaaattgttattgattggttcaaacaatattatttataatattatttatttatataattttaggaataaaaagaattataattgttaatattagattaaattttggttatgatattatatcttatagattgaatttattaaggatttgaattattattttaatattaatagcatcaattttaatttataaaaataattataatttaaattatttttattattattaattttttattattaatattatttttacctttagtcat

SEQ ID NO: 1738 - DNA, 549 bp, Ctenocephalides felis
aatgctacactggctaccactaaccctatgtatgtccagatgcgaagagggaatgtggaaaagcttgtaataccctcaagtgctaaattccaaagtttccatccattaaattttgtatctccagcaattctttccgctcgcacgtattcaacaatatctgtctttcctcctacccagctcagaatacctttcatgaaaaggtttcgttctggcataagtttaatattttcgacaacatcacggctcatcagcctgaaatcaccaacattctcttcaattttaggattgcttattttattgtggagcttatagaaccactcagccgtttttcgcttcaggcgtccatcagttgagcggtcagatcttttagcaagaaccatatcagcacctgcttgccatttttcaataagatgaggaataacctcaatcgggtcttgcaggtcaacatcaattgggattatcgcatcccggtacccaattcgcccttaggagtcgtattacaattcactgccgcgtttacaacgcgtgactggaaaaccctgcgtaccc

SEQ ID NO: 1739 - DNA, 549 bp, Ctenocephalides felis
gccagacggagggctaacactgcctttaacttttcattactccagataactttcaaaatcaactgcaatcatgtccgacgaggaagaggtctacagtgaagaagaggaggaggaggaggaggtcgtggagcaaaaacacacgaccaaagtagaaggcgatgcagctgctggagacccagaattcatcaagcgtcaagaccaaaagagatcagatctcgatgatcaactcaaggaatacatcttggaatggcgcaaacagcgtgccaaggaagaagaagatcttaaacgccttaaggaaaagcaagctaagcgcaaggtatcccgcgctgaagaagaaaagcgtatggcccaaaggaaaaaggaagaagaagaacgcagaataagagaaattgaagaaaagaaacaaagagacattgaagaaaagcgtcaacgtctcgaagaagccgaaaagaacgccaggctatgcttcaagccccaaggatgccacaagaagggcccacttccctcccaaaagacagacttcactgtttctgccaattgaagaacaag

SEQ ID NO: 1740 - DNA, 549 bp, Ctenocephalides felis
aaggaaaagctgtttttgaaggtgaagcaacttcagaagaggctcttaagaaattcgttcaatcacaatcgttgccccttatggtagaattcaaccacgagactgcacaaaagatctttggtggagatattaagagccatttattattgttcctgtcaaaggaaggtgggcattttgacagctatgttgagggagcgcgggaggttgcaaaagaattccgcgatcaagtactgtttgttacaatcaacgctgatgaagaagatcaccaaagaattttggaattctttggcatgaagaaagaggaggtgcctgctatgagattaatcaagttggaagaggatatggcaaaatacaaaccagctacaccagacctttcagcagaaaatattaaagaattcgtaggaagctttattgaaggcaaattgaagcaacatttattatctcaagatcttccagaagattgggataagaatccagttaggtttagtcagctccatttgatgaagtacattcaattcagaaaaggtggtttgnggaatctatgctcca

SEQ ID NO: 1741 - DNA, 549 bp, Ctenocephalides felis
aattgtccatcaaacacgtaatacgttttcaactaaagaacactggctgtggtgttattgggttatttttctcggctcaatcacggtactgcaggggatatacgtcttagtcagttccgatgcaagcgcccgactggctcccggcattattcttatttgcctcggaatgatctgttacagcatattctcaaaagtctggctactggcactggtatggagacgtacctgttcgttagccaacagaataccgatgattcccgtcttcacctgcctgttttgccttttcctggcatcgtttcttgcggaaatggcgcagaccgacatgggatattttattccttcgcgagttctggtcggtttgggagcggtatgctttacgttgttctcaatcgtttcaatattagaagcgggttctgctaaaaaataattgcaacgtaccggataaaaccagcgttgaccatttgcgtaacgctggtttttcttaggcatcatgaaataacgcacattaatgcatagtggtaagtataaaaaacagcaagtactgttttt

SEQ ID NO: 1742 - DNA, 233 bp, Ctenocephalides felis
tcacggttttagaaatggaagtaggatcaatatcgatatgcagaacagtggcatttgggcagtactttgccagattgttcgtcgttcggtcatcaaatcgtaccccgacggcgaaaatcacatccgcgttatgcatcgtcatattggcttcgtaggtaccgtgcattcatcaccatttgctgcacccgcagagcgctaaggcgcagttcattcatctggttaacatactcaag

SEQ ID NO: 1743 - DNA, 549 bp, Ctenocephalides felis
aagtcgctgaacataccaacctcgaaacgcactttatcgattccagcggtttaatctcctgggacctgttcaagcaggatgccgattatccgtttgtggactggaatttctccggcaccacggaagaagagttcgccacactgatggctatcagaaaaaggccatctctcagcgcctctgaacaaggtcaccaatgctgagatagctgaagagatggcggcccgttttgcccgttgctgctgtgcgaatttatccgcagtgtgaacaccgttggcaaatcggcattcgtggaggccgtcggtcgggcgagcgatgatgcggaaggttacctggattttttcaaaggcaagataaccgaatccgttgaattacatcacaccccgcgagagtcgaatcaaccaattttgttttttttacattttatacaaaatttataactaagtatataagtgttgtatttggtttgaatattaaatgcagtatacctttttattaggaaactacaaacattcttgttatagataaaatataatttaaatatntgttgaa

SEQ ID NO: 1744 - DNA, 549 bp, Ctenocephalides felis
aacacgctggctgacaaccgcacgggcagtcagagcaccgttgctgttgaagacttcaatccagtcgttatcggcgatacccagatctttggcatcggcttcactcaaccagaccaccggaccaccgcgacctaaagtcagcatcagcaggttgtcgctgtaggtggagtggataccccacttctggtgcggcgtcaggaagttgagcgctttttcctggttgccgttggatttctggcctatcacttctttcaccgaacgggtgtcgatcggcggacgataaaccagcaggctttcaccgaaatcacgcatccactggtgatcctgatacagttgctgacgaccagagagcgtacgccatgggatcagctcgtgaacgttggtgtaaccggcgttgtaagaaacgtgttcatcttcagaccagaccaggtcgggctggagataattttgcgcggctgtgcctgaatatcgcggaacggatcttctcgtcttnttattcagcgccagatgcgtatggcacgaccggnaattcgttnaggcagccaagct

SEQ ID NO: 1745 - DNA, 549 bp, Ctenocephalides felis
ccgcggtggcggccgctctagaactagtggatcccccgggctggtactttgccaactatgacccgcgtatgaagagatcgcgcataaagccgagctttttcgccaacaaacgggaattgcaccgtttattgtggttttacccgacattaataatgaagccagtctcagacaaaatggtaaagcgatgctggcgcatgcgtcatcttcattgagtgatgtaaaaggaagtgttctgttactatttactacccgcgaaccacggttaattatgatcaccaacggccaggttgaaagtggtctggacgataaacatctcggccttctgatagaaaatcacacgctggcttatttaaatgcagatctctggtatcagggaatcaataatgcattggctgttctacaagcacagatattaaaacaatcgacgccgcactaacgtattatccgcatccaggcgcgggctgcacgacttgttcagcggcatggtgccgtatttatccagcgccagcgagaaacctgctccgtacccgngtgccggaagccagatgc

SEQ ID NO: 1746 - DNA, 549 bp, Ctenocephalides felis
aatttctatcgttatacgaaaagataatcaattccgctagccttaacgcgtgaattattgtcttatcacaacttatcggcaggcgctttcccgcctttcgggtcaaggcccgcatcactcctcaagaatagtttttatcgcttcccccgccattgcagctgttgcacagagttgttctatagagtgcccctctcgtgccttcgcagaaagcccagacatcacggtactcataaaatcagtcacacattgtgcgcgttgtggatgccgcctggcgatgtagtcataaatggtcgtttctgcggcgtgataatattgaacggcaatatcacgcgcttgtggatcatgactatgaataccttcaagaaccatacagccagcgcagccgccgttttggctatatctgcgcgccgcttcttttaatacctcaaccaggcactcgcctaccggacgatcatcacgaagaatatcggcaagcggaatagcttccgtaccgcgtattcattgagtcacggttaataaccagcttactgcaaaaccggtagaggtcgg

SEQ ID NO: 1747 - DNA, 549 bp, Ctenocephalides felis
gaaataatgagagtattttaatatcatcacaattacaaatacgtttggcaaaatgattaataggtttaaatatatttattctaatacaaataagttaataaaaaatacaagttttcaacaaacaaaacgaagttatacgatgcgaagaggtgcatacgatggcgaaggtaaaactgttttgcgtttattaaatcaagatgccgaaatgggcctgatgattaattcatatagtcaagttggtttttccctgaacaatggtgtttcagtaatgggtcctgtagcgatatttcccaggactgttctatcatggaatgtaggaaatagtgaagacataaatgaggcttcattatctttattttataccttagatccaaaattggatgttcttgttattggtatagaacaagaaagtgttaatcccaagttaaggcagaggattatggaaattttacgccaaaaagaattaatgntgaagttttacctactgtgttgcatgcactacattaactttcttatgcaaaagcccagcgtgctgggcatattcccctt

SEQ ID NO: 1748 - DNA, 137 bp, Ctenocephalides felis
accaaccatgacgacacncgatgcatcctttcttctcctgatcgaaggcatcgaaggcattcttgagtagtttgatttgatccttgtcgagctcctccattgttactgtagatcacagacgacgctttcgtncttac

SEQ ID NO: 1749 - DNA, 193 bp, Ctenocephalides felis
actgattttatacgaaatttatagattaaaatcaacgtgtattaattttctgtcaattattgatcaatacataatattataaaattgttgtaaatcattatgttacataatatatataaagtcttgttttaacttatttataataattataataaaaacataaacatcaaaaaaaaaaaaaaaaaaaaaaaaa

SEQ ID NO: 1750 - DNA, 500 bp, Ctenocephalides felis
accaagtgtggccaaagacaatctttattgaaatggtaacaatcataggcgcacaaaaaatccaactncagataattatctaattatttcttactagggggtttgaattcaaatttacgtgatttaagtgctgtccatttgtgtcttttcagataaaaggccaatgcaaaaagcattgaaaagattccaatagccttaatggtcattttcttacgatcatcatgttcaggctcagatgcccatttcaagaatgtagaaacatctttggcgagttgactggcagtggctggcgttccatctgaatattccataacctcattatacaatgcttgagccatagaaatggctccccctgggaaatatggattgtaatactgccttcccttagaattacacctgctggtgggtctgtgtatccagtcaggagtgcaaacaagtagtcttctcctccatgacgagccaatgtaataaaactcaaatcangtggaaaagcccattat

SEQ ID NO: 1751 - DNA, 500 bp, Ctenocephalides felis
acatataagcgaatttttttatatatatcttcaaaaagaaaatatccatatttttgaaacaatttaataaatttctgttcctttaatatttttatcaattcatatgacttagttatacaaaataatcatatgttacttataaacatgtatcatagaagttttacatctgactctgattgttataattaataaaataaaaaaaaaaaaaacatacatacagaagttttacattttattacaaaattaaatacataaatgtatataacttttcaaaattttattataaattcatagatgtttttcatgtttaattatgtgtttctaaccaatcggttttaataaaaattataagaatgtagatattgtagtaaatcgaacatttctgttcttcatctacaagatacaataaatagaaattataaatagttatataataattttgcatttttaatgaaaatcacactgtgtatcatagtagcacttccaattttgcaacaata

SEQ ID NO: 1752 - DNA, 252 bp, Ctenocephalides felis
acttgaacaattcgatgatcttctagttaaaattttactgttagctgctattatatctttcgttctcgccctttttgaagagcacgaagattctttcactgccttcgttgaacctttcgtcattttactgattttaatcgctaacgctattgtcggtgtttggcaggaaagaaacgctgaatcggctattgaagctcttaaggaatatgaaccagaaatgggaaaagtcgtccgtggcgataaggccggtgt

SEQ ID NO: 1753 - DNA, 265 bp, Ctenocephalides felis
cttcttataaccatgtaattntctacacataatgattatnttatttattcacgatatacaacanntgcttttttcttgagtgttaccgtctgctttttctatctcgactaacaaagcatggaatatttcagctactgactcattttgtttggcagatgtttctaaaaatgcggctttccaactatcagctaatcgtttaccttcatctgcacttatcattcgntccatatgtaaatcagttttgttacctactaacactacaggt

SEQ ID NO: 1754 - DNA, 305 bp, Ctenocephalides felis
actacatcaaaatgtgtgcttttcctaagcagctgcaatacccaaagcagcaccagctgcaaatgctcctataaaaatatgtatttcttgcaatttaaattcttcttcacctgtaagaccgtgataccattttttggcttttctttgatttttctttagcaattcctctgctttgtcaattttcctatcaacaaatctctcaattttatccattaatttgggagtttctccagtaacagcctcttcaattttatctgtcaccttatcagcctttttagttactttatcccagtcaatagaaatgt

SEQ ID NO: 1755 - DNA, 500 bp, Ctenocephalides felis
accattatataagtcaggaaatcgtcaatcaacagcaaactacagacccatagccatactgccaatattttcaataattatagaaatgttgttagcattaagaattacaagtttcttcgatgctaataattattttgtaaaaaatcaatttgaattcaaaaagaaaattatcacaattgatgctgtgctagactttttgaactttatatcaaattcactggaagatcataaacactgtggggcactattttgcgatctcagcaaagcattcgattgtgttccacatgacatatttctcaggaaactggaatattatggatttaggggcgtagcccttaaactgatgcaatcatacctatgtaacaggtatcaagtttgtggaatggaacaataaacgaagtgagatagcaagattaaatgcaggcaatgcccaagggagtattcttggaccacttctttttatcatatttgtgatgatctaccaccgaacattagctgca

SEQ ID NO: 1756 - DNA, 486 bp, Ctenocephalides felis
acggtctattaacaaatattctgaaatcaaaatcaaactaatagcggcaagatctcgagtagcaccattaaaaaatattacgctcccccgtctcgaactttgtgcggcacaattgctagcaaatcttgcgcaaataactaaacgtgcattaaatatcgcgtttgataaagaattctattggagcgattccacaatcactctttcgtggataagatctccatcttataaatggaaaaccttcgttgccaatagagtttctgatattcaaacaaaaaccgacgcaaataactggttacatgtccgatcggaagacaatccagcggacctcatatcacgcgggtgctatacacatgatttattgaattcatccttgtggtgggcaggcccatcttggctacaaaatccaactgaaacacagcgacgtgcaactgacaatatttcaattcctgaaactgatgtcgaaagtcgaatcacaagtttgacttg

SEQ ID NO: 1757 - DNA, 500 bp, Ctenocephalides felis
accactgactcctgaatgttaaaaattaagtcgtttattgatttatcgatatcttcttcatttttcaatcgcatttcaagatttgttcgttcatttagtgtgttgcgaaattttttcccaatttgtgaatttattataaagtattctgttgttttttataggaattggtgcaattcctattgntagaatgattggagaatggtcggatgataaatcaaaagatggttttatttcaatgttcttatcatcaatatcctttgtaatgaagaaattgagcagatccggtattttattagtatcgctcggccagtatgttgggcttccagttgatatgtaagagagattgtttttatctattgcatttaataattccttgcctctagatgtaattaatcgagaaccccatcttgtatgtttgcaattgtaatctcctcctacaataaattttgggcctagttgtgaaagaaaattttcgaaatcaatctgttaatttatgtcgt

SEQ ID NO: 1758 - DNA, 270 bp, Ctenocephalides felis
acatgaacttaatcctgattttaaaccaccaaaaagaccatttaaaaggatggattatggtgctgccataaaatacttgagagaaaataatatcactaaagatgatggaacattttatgaatttggagaggacataccagaagctccagagcgcagaatgacggatgcaatcaatgaacctataatgctttgtcgttttccagcaggaattaaatcattctatatgtccaaatgccctgagaacaaagaacttactgaaagtgttgatgt

SEQ ID NO: 1759 - DNA, 500 bp, Ctenocephalides felis
acatttttacatttttaaatataatacaaccttatataagtatcacaccatcttgtatttatgaaaatagtctcgcaaactcttcgaagttgatgcgtccatccttgtccgtatcggccaacgtcatcaactcggtgacctgctgctccgtgacattttcgccgatcatctccatggcggttcgcaattcgtctcgggaaatgtatccattaccatctcggtcgaacaccttgaaggcagatcgtagatctttattgacatcatcgttggagtctgaatctcccccttgtctttgggttccgccttgcattgcctgaactgcttgaatctttgcgatccattgtaaaaactcggtctcgtctattaatccgctaccagactgactagcgtctttcatcagatcttgaataagttcatccctcacgtggattcctagattttttaacataaattgcaaccctgaagccgtacatgtccatcctggtgcgatccagcaaccc

SEQ ID NO: 1760 - DNA, 500 bp, Ctenocephalides felis
accaccgtctggaccgctaggatccttgatttctagggtaagttcaaatacttcttcttctacatctaccgttcgtattttaattttactcgattctttaacgactgtggttccgcgataccaaacgacatcaggcttgggcttagctttacatttacatttcattgttattaacgagcctgtttcattaggaataattcttggtttttcgatgaacgttggcgcgtatcctgcagcatcatcaccgctgtcgaagttcaagctgatagtcgcattgctttctccaagttcattctttgcagtcacacgatatttgccagcatcctcaacagtgacatttttaatctcgagtgaagcaaagtatgaatgaccatctttgtcaaccatcaacttgtgtcttggtgagtccttaacagggttggtattgtgaaaccaagcgactgtaggtttaggatcagcttgaattcggcattcaaagagcaaacgtttgcatcatctct

SEQ ID NO: 1761 - DNA, 500 bp, Ctenocephalides felis
acctaacgatcaattcattacagattacttgaatgacggtaatttcatagactagcccattccaaaaattaagtattctgaagtgctctacgagattagtaacactaaattggtaaaaacacttggtaatgatgcgatcacatttggactaataaaacaccttcctgataaaggtaagagatttttaacgatattattgaatgccataatacggctgaagcatttttcttcatcgtggaaattggcaaaaataatcttaattctcaagcctggaaaaaatcctactgatgcagtttcctaccggcccattagtcttctatcttgcctctcacatttttttgaaaaagttattcacaaaagaatcattaatattttagaagataataattttatgccaaaacatcaatttgggttcanttagacaacactgagcaaaagaacaaatacacagagtagtggattcatttataaagcctttcacttaaaaaaaatggtcagcc

SEQ ID NO: 1762 - DNA, 500 bp, Ctenocephalides felis
acgggttgatcttagcagcctcagcatatccttttttccacatcctgtttttagcttcaaaataagatatgttatgtagtgccatcatttcttttatttctttatttgctttgaagaatttacattctttgtcgtttgcttgatggtttccatggcatactgcacatataaagtctgacacgatatggcaattttcatgagagtgttcttctgaacaatatcggcatcttatcttgcttttgcattagttttttatatgtccataacgccagcatttgtggcattgcattacagattgaatgtaaggacctacagcacacctaaccgaatacattgaaacgtattctggcagatagttacccctgaacactatttttaccatttgcgatttcatatttgtttattctaagtttttttaatgcatttgacctctaatattttgatatccgatctaataacatccatgatttcttgctcgtcatgtcgggttcaacgttaaa

SEQ ID NO: 1763 - DNA, 500 bp, Ctenocephalides felis
acctgggcaaaggtggagaagttgccaaattaaccaaagaagcaatgaaaggcagcatgtccttccaagaagctctcacaaaacgattagatataatcagaccttcacaacagaatatttcagacttcatcaaagatcatccatcaacactcacacctggaataaaaaacttaattgcatccttacatcggaaaagaataccagtatatttggtgagtggaggcttccgatcactcatagaacctgtggccaaagaattaggaattccatatgaaaatatatttgccaatagaatcatattttattataacggagattacgctggatttgatgcaactcaaccgacatctcggtctggcggcaaggggcaagttctagcgttgctgcggcagcaaaagggttacagacacattgcaatgattggtgacggtgctacagatttagaagcacaggctgatactttcataggttttggcggaaatattgtcgagaagaagtca

SEQ ID NO: 1764 - DNA, 315 bp, Ctenocephalides felis
ctcgtgttatttttttaagttgtatttttttgtttagttttaattttataaaatgtgatcccccgactgtaactttgccccagggcgaattggttggaaaagctttgacgaacgaaaatggaaaagagtattttagctacacaggtgtgccttatgctaaacctccagttggagaacttagatttaagcctccacagaaagctgagccatggaatggtgttttcaacgccacattatacggaaatgtgtgtaaatctttaaatttcttcttgaagaaaattgaaggagacgaagactgcttggtagtaaacgtgt

SEQ ID NO: 1765 - DNA, 500 bp, Ctenocephalides felis
acccctttaagtgaaagattatgtatttgggagaaggctgcagatttaatggccggtgtttatagacaagaattaaatgctgcaaccatgttaggacaatcaaaaacagtcattcaagctgaaattgattctgcagctgaattgattgatttcattagaatgaatgccttcttcctgaaggaattaactaaataccaaccaattagcgaagatttgagtgttacaaggaattctatgcgtttccgaggtattgatggatttattgctgctgttagtcctttcaactttaccgctattggtggtaatttggcctatacaccagctttaatgggcaatggtgtattatggaaaccatcagacacagctttactgtcaaattggatcatattcaagatcatgcgtgaggctggtcttccaccaggtgttgtcaactttatcccttgtgatggtcctgtatttggtgacactgcactgcctctctcatttagctggcattaact

SEQ ID NO: 1766 - DNA, 456 bp, Ctenocephalides felis
accacgtatctaatataatttaaaacttatttgagttatgtaaatcaataatctcaagtataactggcaaattaagatttgtagaaaaataaccaaagtaatgcgacaaacctttacatcacaatgcttctaggttggaatttgtttcaatggtcaactttttctcctgactcatttcatatgcaaccgcccttccagcttgatataattgtgttagtccaacaaacatattaacagcaaacaaactccaggtttttggaattatgactaaggagtatctggcccatacgaatccagttacagccaatgatcctgattgtctaactgatagttgctcagctggcctggataaatctcctatgccagctataaccagaccccatttaaaaagaggtgcccaaaagaagacagtttttggacctgtggtgaattccataacggtaaagccgattttgg

SEQ ID NO: 1767 - DNA, 500 bp, Ctenocephalides felis
acgcaactaatgcaatataaatttgtttcaagtcaacaatttaacaccaaaaacaataatagatcaaaatggtcctttcaaatagctgatataatgtataatgtttgagattaggttatataaaagttgaatgttttttgattctttaataaaaatatccatcactgatataactaaattacgcagtaatcataattagaattatgtctctagcaacagttattctttctcagcaatagcggtcaagtgaacatctaattctgcctctgtcaaaaccctaaatttaagattttctttcgtaaccaccgcaacctcaatttctgaaggtttgaagtcaacacataacactgttgataaacatgaaattgccaactggacagcttcatcaaatgtataatcctgtttcttcttcagttttttctcaagatatccattggcttcagtttgctttacacccacactaatggctctaaaaccacagcagtaaccagcaggatctg

SEQ ID NO: 1768 - DNA, 549 bp, Ctenocephalides felis
gataaacgatcacctaaaaaatacggtggtaacttagatacaactggaagtccttccagatctcgtagcgctaccaaagaattaatattgcccccagatgattctctaatgtgcaaaccagattttacaactcctttaaaagatagatctgtaaaagatggtgatagtttaacattaacatgtaccgttaagggtgacccagaaccacaagtttcgtggtttaaaggcggcaaggcattgagttcttccgaaattatggacttgaaatataaaaatggcgttgccacattatcgataaatgaagtattcccagaagatgaaggtgtttatgtttgtaaagctaccaattcaattggagttagtgaaacaagttgtaaattaacggttaaaccaatggcaaacggcaaggtgtctaagaaagctcaggagacaaaccacctaaaatagtgagtcacttagaatctaaatacgtcgaagatggacacccgcacgttatcttgtagatatagatgctgagaaatcatgtcgctggtgnacataccaagaaat

SEQ ID NO: 1769 - DNA, 549 bp, Ctenocephalides felis
aatcaccgctgtaaccaatgcgcgagttaatctcaaaaggcgtttcaccttttgccatatcaaacagtggtttgcttacttcgttattaaccagcgtggtttgaattgatgccatcgacgggatcaggttcagttttttaagctgggcaagcgggaagggaccatgatcaaccgattcgttgaagatgacgctctgaccgcttttaatccacggattttctttcccggcaatgggtttcaccaacagttgcaactggctgctgaatacgccgcgatgatagttttgataactcacttccaggttggattcaggagctgtcagtttgagttgcgcgttcgcctgcgcgaccatgtcttcgagatgggtttcaatcttcttgcctgtataccatgcgccgctgtccagactacgcctagcgcaacaatgacgcctaccgctaccagcgatttattcataatgattatcataaaatgaaatcaggcggactgccgctgaaggtgtataagcctttaataagcttacaagagatgtaatttttcagtagctct

SEQ ID NO: 1770 - DNA, 549 bp, Ctenocephalides felis
aaggatggagtcactgtagcgaagggtattgatctcaaggacaaatttcagaatattggggccaaattagtccaagatgtagctaataacaccaatgaagaagctggtgatggtactactactgctactgtgcttgccagagctattgcaaaggaaggctttgaaaaaatatctaaaggagcaaatcccattgaaatcagacgaggtgttatgctggctgttgatgcagtcaaagaatctttgaaaggaatgtcgaagcctgttactaccccggaggaaattgcacaagttgctaccatttctgccaatggagacaaagctattggaaaattgatctcagatgcaatgaagcgtgttggaaaggaaggtgtaataacggttaaagatggaaaaactttacatgatgaacttgaggtcattgagggcatgaagtttgatagaggatcatttcaccttactttatgaattccagcaaaggtgctaaagtagaattccaagatccttattttgtcagtgacaaaaaatactcagtcaagcatattctgcttg

SEQ ID NO: 1771 - DNA, 549 bp, Ctenocephalides felis
gctcaacgagtaataatggtcagagcgaaatattgtttttaaaaaattacgtcatacaaatatcgaattacttttgaatctaaaaatatccctggtgaacatttttgatattaagacgttttacatcgaaatttttaagtttgcattttggcgaaaatatttgttacgtgttcgttacggaagtttgcttaaaaactctggtgaattttgaactcaaaatagtgtctgttggtttttttaattgttgtgttgccgtgcgggtcgcagaaataaattggtgatatggcacaattaatatcagttcgattaaatcgaggagatgcttgtccgtggggattcagactccagggtggcaaagatttcggcactcctttggttattcagaaggtgaacagcggaagcccggccgagcgagctggctgcaagcaggcgacgctgcatcaaggtgaataacacagacgtctataatctgagacacaaggacgcgcaagacgcctcggcgcccggacatcttgaggtgcagtcaaagaggtggatcacatggcaccc

SEQ ID NO: 1772 - DNA, 549 bp, Ctenocephalides felis
taagaaagttgctgaagaatttaaagaagttttagacaccttattgnggaatgatgaatatggtgtttggatggactacgattcagaaaatagaatatcgagaccttatttctacccttcgaatcttgctcctttgtggactcaaagttataaggacgttgagtgtgggagtggtaaaagtttgggagtagacaagaatgtgcaggataggattgagagggttttgcggtatttaaatagtccagatgtagcaataaaaagctacccaggtggtgtaccaaccactttattgaatacaggagagcaatgggacttcccaaatgcctgggcacctcttcagcatatggtgatcctgggattggacagcacagataatcaggaagctaaggatttgtcatttgatctttgccagaaatgggtccgatcaaatcataaagcttacttggaaacgaatcatatgtatgaaaagttaatgcacacatgctggggcaccangaaatggcggagaattgaggccacttggtttggtggcgaatggtnctattagac

SEQ ID NO: 1773 - DNA, 549 bp, Ctenocephalides felis
gccgtattcgcagacttataaattagtcgtcgtgggcggaggaggcgtcggaaaatctgcaataactattcagtttatacaaagttattttgtgacagattatgatcccaccattgaagattcatacacaaagcaatgtgtcatagacgacatcccagctaaattggacatcctggatactgccggtcaagaagaattcagtgcaatgagagagcaatacatgagaagtggtgaaggatttttgctcgtgtacgcagtgacggatagggctagtttcgacgagatgtacaaatttcacagacaaatcttacgtgtcaaagacagagacgaatttccaatgctgatggtcggcaacaaagcagatctcgagacgtctcgcgtggtgtctgttgaagaggcgcaaaatttgtcaagacaattaaaaataccttacatcgaatgtagcgctaaattgagaatgaatgttgaccaatccttcctgactagttagaattgcagaagatttcaattatcagaaaggcagatccaattaaatcaattataggataa

SEQ ID NO: 1774 - DNA, 549 bp, Ctenocephalides felis
aattattgccggatgtctgctggtgatgctgccagcgatgggcctgttctatgtatccgacctgatgggcggtgcgaaaaacctgctgatcggtaacgtcatcaaggtccagttccttaatattcgtgactggccgtttggtgcagctaccagcattacgctgactatcgtaatgggcctgatgttgctggttactggcgcgcttctcgtttgctgaataagaaggtggaactcgaatgatcggtcgactgcttcgcggcggttttatgaccgctatctacgcgtacctgtatatccaccatcagttcaagacgacgcagcacctccggccgggcatcatcctccgtcatggcacagagaaaatcattcagcgtccccggttgtgaatcttcatacacggtgatggtcccggcgtgcgatggtggaaaaccgtcaacctgcaggatgacactgtctgaccgtactccacatcatgctgtaacgcccggcttatccggatcttgacccacgtgttcaccaccaccgtggtgctgtacgtctggtttactg

SEQ ID NO: 1775 - DNA, 549 bp, Ctenocephalides felis
gaaacgagtcgcatagtgcacttctgaatgtgacataatcccaaagtctaaataacaaaaatactatttagatggagagtgctatccctgacgtatacgtgaattgatacgtgcaccttttactatcaaggtgatacactcgtgcatcaagtgataaagagtgcctgcaatttatttttattttagtttgtccgtgaattgtgtttttcgttgtgtaacccaagcgccaaagtaacgccgaaacagacatggaggaaatattacaagaaattaggactataaaattcacacgggaggaagtggaatcgttgatttactggcgttgtccgcgtaagtctggcatcgtattcggcgtgtccctcgccctgctgctggcgttatcatgcttctccctaatcagcgtgttagcgtacgcttccctcacagccgtctgcggctgcatggccttcgtatctatcgcaacgtattgcaagctgtcagaagacgtccgatggcatcctttaaggagctgtggaaacagatgtcagtgtgtctaagaaaacccacagn

SEQ ID NO: 1776 - DNA, 549 bp, Ctenocephalides felis
gctgatggttgcggatccgctgagagcggatatagtgacgaacgcagtgatgaaagcgattgcgagactaaaaatttagctaatgattgtactgataatttagataatgatgttgaacatgtaggtagttcgaatgatattgtagaagaagatgagcacgtactgagtcacaataatgatgtagtagaagacgaaattgtgaatgtaataaattcgattgaaatagaagaactctctggtaatgacattaatgaaatagacggcgtggaagtagaagacgagactgatattcatattaacaaagaaaacagttgtaaatctgattttaacacaacgcaaattggagatggctcaaataatgtgacagtcgttgcaatccagataaagaaggagcagatagcacacttgaacttgaagcgcaatcgtgttcaagttctggatcttttaataaaatctctaatattgtaatgatgaaaaatctcagaatttagacaaattgacacatgcaaagacgataagttgtgcgtgtcagacctctcatcgcgagtt

SEQ ID NO: 1777 - DNA, 549 bp, Ctenocephalides felis
aacgaagaaaaacaagattaaaattcaacacggatcagctgtgtattgtattatatatttggataacaaagtatttgtatcgtttgcaaatggcgatattagtgtttacacaagagatcaaacgggttggaatacaaacgacccaacgacggtgtgcgttggttcaaatgtggccgcccgtactaagttgcttcccgtcgctagtcgattgtggtgttcggcgcataatcatatcaaaattatcaatacagaatcattacaagttgaacaaacgtttcaagtcaacaccgatatcaataagccaataacaaatatggttactggaaattcgggggtttggatatcgttgcaaaattccgcagttttaaaatgttatcatgcaaatacttacgaatgtgtctggaagtaaatattgctccgagtgttacaaagatgttagcggcttgcgatgatattattcgacaacataaagcagcgtgtttaagagtgcagcctgtagcttgcaaagattatatggataggaacagtgctggagtatattgcctccat

SEQ ID NO: 1778 - DNA, 549 bp, Ctenocephalides felis
atacgtgataaggatgactacccatatataacattttgccatgttattatatattttttcatgctagcttcatagaaatttttcaaaattaacattaaaacattgttcatacatttcgtttaataatttttatgtttaaaactcattggtcaccttaataaatgtacataacttattatttctttgcaaatccagaattaggacatttttttcaagtatgtattatggctctcaaaatttagtttattcttatatcgggttttattttcctggacggttttcaaccgcaatcacagatatgatggacgtggagccctagcggatctccaagcccatgaagctatatcacattgggactacaatgaaggacttagtgatgaagaaagaagagcagaacagctttgcgatgaagagaggtcagagcgttgtatgagcggcggaagaagaagaaatatataaagaagaggtaatgaagagggcacaacaacagatcatgtgaaagtnatggcaagtgcattcaattatcagatgttggtggtgggatgatga

SEQ ID NO: 1779 - DNA, 549 bp, Ctenocephalides felis
aatttatttaatgatgagctttttactcagtaatataaaatattgaattgttatttttgtgtgttgtttaagataaaaagccgtatttattattacggctttaattaataaaaggcaggctgtattaaaattaatattcaaagcataaaccgatagccaataccggtttcagtaatgaaatggcgtgggcggcgggatcctgttccagtttttgtcgcagatgtcccatataaatacgcaaatagtgactgtgttcgaccgcgtttggcccccacacctggttaaggagctggcgctgggtgagtacttttccggcattgttgagcagcaccgccagcaggcggaactcaattggtgtgagatgcacctcttcctcaccccggtgaatcacgcgggcggctaaatcgacggtaacatcggaaaattttaccagcggatcgggcgcggtggtggagagtggcggcgtaatgcgactgctgtacttcggcgtgcacaacattgccatgctggcgtattatcgcgtatgggatgctgcgtgatggtgaggtg

SEQ ID NO: 1780 - DNA, 549 bp, Ctenocephalides felis
ggtacacaatgtacggtcccgatttatccattgattctgcaatatattcaaatcttgaaagtgacgaactaaaagaaattattcaggatgatgacaaatttgaagaaatattcaaggaattggcccaggttaaaaactgggaaaatcaaaaggaagcaatgatagaaagaaataangctcttgccgaagcaaatcttttacgcaatcctgacttagctgaaataaaagaaaaattacaagaactttctgaagaaggcaaacaattatgtaccagtatccaagaaatgcttgctgaaataaaagaaaaatctggaagtatcagtttggatacagctttagctctgttacaaacagcagctgcaacaagcgaagaagaatctgaaaatatagcagatcaattcatttcacgtgatattgatatagatgcatttttagaacagtttgcatcatcaagaaaagttatgcatttgagaaaagtcaaagctgataaaatgaaagacttcttnccaaagaaatagtagtatcaaataatcttatgtgcctagtgta

SEQ ID NO: 1781 - DNA, 549 bp, Ctenocephalides felis
gatagttcatgctcgccggtccgtgaaactaccaaaaacaaaaaaaaagaataataaaaaaaaatcgtctcaattgaatttaatcggaccgtactaaaaaaaaagaaacttattactgttattgttgcgataatttcgaaccgaagaaaattaaattaaatccaaacctattgtgtaatggcgtttttgagatcgtctattcagtgtaataatttactaagaaagttcggcataataccaaacagtttgcaatcgttgtcgacaccgtgtgcgtctcatatacatggaataaatacagattcttcaaaaagtcaacatgttgcaagcccagctcaagcccatgtacagaaagaccctttggacatatcattcaacgatcacgttgcagccttcaaaagtaaaaagacaagtgagctcgttcgggcttcatcgtctatgcactatgcacctcagaatatcttgtggaaaataatatgaagctaatgaaaatatccaaggcgatcttaggcgagaagctgtcacagcctaatgaagcttcgtctatggcnt

SEQ ID NO: 1782 - DNA, 326 bp, Ctenocephalides felis
aattgctcaccgtgtaaatcttccagcaccgtcaggttgatgcgcgagcgacgttccgctacttcctcgcgcagaccatcaagccctttttccagcagcagcgggaaattcaccgccaggtgcgcatcgccggaggtcatattgccttccgctttaatgattccggtcgccagcagacctttttgctcatcggtaaacatgccgtagcagcgatcctgtncggtctgaccgcgccaccacgggcacacttcatgcagaacgcgtttgttctcttcgctcaccgcaaagccagcaccgggacgatctgccagatcatcaatctcttt

SEQ ID NO: 1783 - DNA, 549 bp, Ctenocephalides felis
ggaacatctcctgaattacatatgctaatattgttttgtgattgtatgacacattatgtcacaatacttgatgatttggaaatgtatgagcagcaaaatccatttaaattatctgatttcgttgtaatttcaaattttttgaatatgtttttatataaagcgatactgggaaatctatttgatttgaaaaacctatcagggtgtccattatttgtgtcaactcatactttgttattagctttgtatagacgagattgtcgaagaccatttacaccaaactcacattggcttgctaaagatatcaggccatctacttttatgaatgatcttgacaaaggaaaaaaaactactcaggtgcttttacaaaaaatgccgcacataataccacatgaagaaagggtgcaattatttagaaagtgtgtgtcaaatgaaaaggctgtgttaggtttaactgaatcagcatgtgtatcacccaaagcactttgatactgtcatagagacagaattgtgaagatggatatcacagctgctgcgtgcaaccatgcttaa

SEQ ID NO: 1784 - DNA, 327 bp, Ctenocephalides felis
agttgattgaaaaggtctgatgtgcatgccattgcgcacctgaccggnggcggcttctgggaaaacattccgcgcgtattgccagataatactcaggcagtgattgatgaatcttcctggcaggggccggaagtgttcaactggctgcaaacggcaggtaacgttgagcaccatgaaatgtatcgcaccttcaactgcggcgttnggatgattnttgccctgcctgctccggaagtggacaaagccctcgccctgctcaatgccaacggtgaaaacgcgtggaaaatcggtatcatcaaagcctctgattccnaacaacgcgtggtt

SEQ ID NO: 1785 - DNA, 549 bp, Ctenocephalides felis
aatgttccaccagcaggggaaataatgttgttctggctatcggtcaccaccacgcccacgccaggacgtgacgtcttaatcgcctggggatagctggggtctgtggttgccgtcagactcaggttgacattaactaatcccgcgtttcccgtgttacacctgactggaattgcaagttctgccgtctggccccaagaggtttatgccctacaacacggaaattggcagcgaagacatcacctaaatcaacttcaattgtctctccggcattgacggaacatgagccaagtgaattgatcgtaccagacaggtaatacactaaaaccggtgtacctgtagtcgtgcaggaatcacctgcgggtatgttgtagcattcatataatcgcgccagcgccataggaggaatgacgaccgagccaacgaacggctgcaatattttagggaaaagctaccgctattaccgctgccccctgccactaaacgttgaccgcagggtcgaaattgcctcggttcccccctgtgcccacgttttcaaggagcccggtccca

SEQ ID NO: 1786 - DNA, 549 bp, Ctenocephalides felis
cgtttacgtggtggctctaatcaggcttttgttctaaaattttgctcagctatatttcttttattggattcatttggcctgcaacttatttagttttcaaagtatagtggcaggatagaacgtaatcatagaatttatgaaatttttcatacttcttggtcaaatctgtggtgatgtgttaaatattttcaatacggattagtgtatctgaaaatatatatttggcaaatttgttattaaatatttagttatcgcagacgcacagtaatacgaagtagtatttaatgaatactcggtactcttatcacaggatgctattgtatgaaatggggttttagagtagtcacctccgtctcgcatcagaatgctcactaggactgtctacaaagattctggtttataatgatctcacttgtttaatcacacgttaattacccactattgttgaatatatatatatatatatatatatatatatttatatatatatatatatatttatatatgtatatatatattatatatatatatatatatttatatatatat

SEQ ID NO: 1787 - DNA, 549 bp, Ctenocephalides felis
ttccaaaatagnganancagttaattttagacaaatataaaataataaataaatcgaaataaagtttgatgaacaatatttattattaaattgcgattgcacaatttaagcagtataacgaaatggcgttacggattttgaagcctttaagaaactctcttggaatttgtcaagatatcaaaaaggcttcgacgctatctgcatttgatattcaacataaaacccctcttattaagcaatcagatgaaattccaaaagcacaatatgggggtcgtcacgcagtcacaatgctgcctggtggcggtattggtccggaacttatgggatatgtaaaagaagttttcagatatgctggtgtgccagtagattttgaagaaattacaatagatccttctgtacattcagatgctgatttagaatatgccatcacttcaattaaaagaaatggagttgctattaaaggtaatattgaaaccaaaagtgaatctgcacangtattatctcgtaatgtaccctgagaaacgaatagattatttgnaatgtttaaac

SEQ ID NO: 1788 - DNA, 549 bp, Ctenocephalides felis
gtnagccaccattacatccggtgagcagtcaggtgcggtgatacgtggtgtttttgatgaccctgaaaatatcagctatgccggacagggcgtgcgcgttgaaggctccagcccgtccctgtttgtccggactgatgaggtgcggcagctgcggcgtggagacacgctgaccatcggtgaggaaaatttctgggtagatcgggtttcgccggatgatggcggaagttgtcatctccgcctctttcactcattaagactgtaaataaaccacctgggtctgcagatattcatgcaagccatgtttaccatctgcgccgccaataccggatttacgccatccggcgtggaagccttgcatagcttcgaagttttcacggttgatgtaagtttcaccaaacttcaccctttaatggctttcatcgcgacgttcagattttgggtatagattgatgaggtcaggccgtaatcactgcattagccattgagatagcatcttccagcgtgtaaatgcgcaactggcagcaccggccaaagtttctatgctatcga

SEQ ID NO: 1789 - DNA, 549 bp, Ctenocephalides felis
aatgcccatacctaccnttccgcgctgccccgtcgcctgctccgccatatcaaccaacgtggcgatcgtttcaatagtctgccggtaatcatcacgcggcgtgggcagacgatggcggtacaactgctcccctgcatcgcccagtgcaatcacttcagttttggtgccgcctaaatcgatacctatacgcacggtactctccttatttttttcaatatcaatagcgtagagacggacaaccggattggcaatgcaaggccgccgacaattcgttatcatgcccgctaaatttaacgacaaggccgtggaaattatcatgctgtggttcaaaaatttaatggtttaccgtcttagccgcgagatttcgctgcgtgcagaagagatggaaaaacagctagcctcgatggcatttaccccatgcggcagccaggacatggcgaagatgggctgggttcctcgatgggatcgcacagcgatgcgttaacgcacgttncaatggcaaattgtatctggcgccaaagaagaaaaatctccgtttcggtgataaac

SEQ ID NO: 1790 - DNA, 549 bp, Ctenocephalides felis
gcgagaccaatgtcaccggcttaacaatctatcaaatttgccgggccgtcgactggacaattgtttcacaaatgatgttattttgtccaacaataaataatagtcccagtgttttaaaacgtcagcgatacgctgcaaagtgtacaagtgtcatatatgttctgtagtcgtgtctgcatatcgatccgttttgccattgccttgaaaacgccatattgtatgtactttacgtagttatatccaacttttgaattaaatgtgttttaagtgtttaatgttattttcctaaatcttgtatttgattagtaacccttaatcatggatagaaggaagctttccacttctggtgatactttataccaaatattagccattccaaaaactgccactcaagatgaagttaagaaaagttataggaaattggcgttgaagtaccatcctgataagacccaaataatccagaggcgtctgaaaaattaaagaagtaaccgacccatatgatactagcgatgcagcaaaagaacatatatgacaattatggtcttagga

SEQ ID NO: 1791 - DNA, 549 bp, Ctenocephalides felis
aatcggcggtgcgccncaacgtattacctgggaaggttcgcagaaccaggatgcggatgtcagcagcgacggtaaatttatggtaatggtcagctccaatggtgggcagcagcacattgccaaacaagatctggcaacgggaggcgtacaagttctgtcgtccacgttcctggatgaaacgccaagtctggcacctaacggcactatggtaatctacagctcttctcaggggatgggatccgtgctgaatttggtttctacagatgggcgtttcaaagcgcgtcttccggcaactgatggacaggtcaaattccctgcctggtcgccgtatctgtgataataattaattgaatagtaaaggaatcattgaaatgcaactgaacaaagtgctgaaagggctgatgattgctctgctgttatggcaattgcggcatgttcttcaacaagaacgccagcaatgacggcagctgctggaaaaagtcgagctgcggaggataacccagcagactggaggagtttcgaaagatggaaggatccagtcccaattcc

SEQ ID NO: 1792 - DNA, 248 bp, Ctenocephalides felis
cagagacttcatatgctttgatggtaataactttctgagtcctgatgcatttgataacgaaaaaattaaagaacgaaaattaacttacaaggcaaggaaaaacgatagagaaactatgtgtcccaaaatataggaaaaacaagaattatcaaaataatctaaatatatttacaatgtaataaaatattatatataaaaataaaaaaacgtcatnnttcaaaaaaaaaaaaaaaaaaaaaaaaaaaaac

SEQ ID NO: 1793 - DNA, 549 bp, Ctenocephalides felis
aatccacaattgttacncgtaacaaatcgaatcattgaacgttcgcgcgagactcgctctgcttatctcgcccggatagaacaagcgaaaacttcgaccgttcatcgttcgcagttggcatgcggtaacctggcacacggtttcgctgcctgccagccagaagacaaagcctctttgaaaagcatgttgcgtaacaatatcgccatcatcacctcctataacgacatgctctccgcgcaccagccttatgaacactatccagaaatcattcgtaaagccctgcatgaagcgaatgcggttggtcaggttgcgggcggtgttccggcgatgtgtgatggtgtcacccaggggcaggatggaatggaattgtcgctgctaagccgcgaagtgatagcgatgtctgcggcggtggggctgtcccataacatgtttgatggtgctctgttcctcggtgtgtgcgacaagattgtccggtctgacgatggcagcctgtcgttggtcatttnctgcggtgttgtccgctggacgatggcagcggttgcaaataaa

SEQ ID NO: 1794 - DNA, 446 bp, Ctenocephalides felis
aatggctccagcgcttcgaaaagtttatgatcaaatgcctgaaccacgttgggtaatctctatgggtagttgtgctaatggaggaggttattaccattattcatattctgtagtgaggggttgtgatagaatagtaccagttgacatatatgtaccaggatgtcctccaactgcagaagctttgttatatggttgtttacagcttcaaaagaaagttaaacgaatgaaaaccctgcaaatgtggtatagaaaataaattattgaaaaggagaatattaattataaaaaatatgctatatcaaaagtgtagaattatgtttacagtaatgtaaacaaattttattttttcttcactaattattgaaaataatatgttcataatcctatagcagaatttaataaataaaaacacattttaaaaatgaaaaaaaaaaaaaaaaaaaaan

SEQ ID NO: 1795 - DNA, 549 bp, Ctenocephalides felis
attcatttcaatattgggtgaaatcagtatgaattcattattaagttcaatcattattgtggtattttcggtatggttaagtgtaatttttgcagttaacgtaaagcccaaaccaaatcaagatgattactgtaatctaaattgtacaaatggaccaaatgtaggatgcacaaaaccggatgtacctagagactgccaaaactttaaacttgtgaatataacagaacgtatgaaaaaggcatttttaaatgcacacaatagaaagagaagacttgttgcagccggaaaaggtcttctgaaagatggtgtacacactccaattgctgcaaagatgcccaacttaacgtggaatatagcgctcgccaagttagcagaatataacgtgaagcaatgcgaaatgaagcacgattgtgctaaaactagacatggtcacactggtcaaaacctattttttatggcactactctcagcccataaaaaactcaactatagcaaaatggcagttgatggttggatgtgaagcaaagatacangattggagatataaga

SEQ ID NO: 1796 - DNA, 549 bp, Ctenocephalides felis
aaatgtcattgcgttnctatttttgattatttcatcagtatttcaataaatccaacatatgtctcggcacacatcattataattaaattattagtatcatttccattaatttattttactggcgtcaatatgacggtatcaaacgacgaattagttgaatcttttaaagctttaggtttaagtgaacaaaaggcgaaagaaacgttaaaaaatacagttgttacgaaaaatttaacattagcattacatgaggtgaggggcattattttgccccaaggagctggttctttaatctattatgtggcaacaaaaatcaaaccacagattatagatcaattgcctgtacttgtaaaatatatatcaacatcaaaattagacacaacagttagagttgatgcggccttgcaatttatgttgtctcatttaaatggatatcaaatcgatgaatttgagaaggcttgtggaattgggttgtgtacacctgaacaaattgaaaaagcagaaatgaggcttgtggaacataaagaggcaattttgagaacgatacag

SEQ ID NO: 1797 - DNA, 549 bp, Ctenocephalides felis
antccatataatcggttcgcgaactggttcgaacacatatctgtgtacacgtgttagtatcaaattaattattaaaagatataacgatcgaatcatataagatattttgtgattatccgcgagagaaagaataaccgcttcgctgacgtagttttggttatcagttcatttgattcggacgttccggcaacttgttagtaaacatgagtttctgtgagaacaataactacacggtggatgaatgttcctatgaaaggattaaagagacgacagaatttctaattcagaaaaccaaatatcgaccaaaaattggtattatctgtggatccggaataggacccctggctgacaatttacaaaatgcagattccttcgattacagtcaaattcccaactttcccgtaagcacagttccgggtcataaaggtcgacttgtatttggcaccttgggtggaatcgaggtcctttgcatgcaaggacgttttcattattatgaaggctattcgtgaatagtgtgtttcggtngagtatgaaatactggcataccat

SEQ ID NO: 1798 - DNA, 549 bp, Ctenocephalides felis
aattttattttgcattactaccttatataacgaaaacacaaatgtaaaactcatcccacagatgaattacctgatggttgttgtggctttgtttttccttaacgccgtcatttttcttttcatgttaatgaaatatttcactaacaaacaaattttaccaacactcattttaagccttgcatttttaagtggccttatctatttagttgaaaccattgtaattatccataaaccaattaacggcagtacactgatccagacaaagtcgaatgatgtttctattttctatattttccgccaactcagttttatttgtttaacctcgctggcgctcttttgttatggaaaagacaacatccttgacaacaataagaaaaaaacgggaatcctgttgctggcgctgatcccttttttagtttttccccttctggcacacaatctgagcagttataacgctgactattctttgtatgtcgcgatactgtcggacaaccatactgcgacctggggaataacttcaaaatattggtttgctgnggcttttactgt

SEQ ID NO: 1799 - DNA, 549 bp, Ctenocephalides felis
gtaacaaacatgacgaaaaaggtgtcaccaatttgagcatagcagcaccacctcaaccattttctgcatctcaaccttcaccatcggtcatcacacgtatgctgcataatccaggtggaaatcctccagtgtctattaatccaactgctccagtcacttgtgattccaatatgcctactggatctgtgggattgaccacctccccttccagctttcaaggaaaatattacccgcattctgaaaattatttacaaaggcctaggggaccaatgggagcagctatgggaatttatagacctgcaggccctatgggtaattatccaccacgtggtatgtatcattctcctcatcatccattagacccctcaccttctggtggaggacctatcaatgtgcagcaaatattctcccgacgtcagcgcctggacaaattggagctcaccacctttgagactgtactcccccaaagcgcgtatgccctatgaatcatgcatccagcatanggcccagcattctaattttnaaatcacttatggctatnanggcacc

SEQ ID NO: 1800 - DNA, 549 bp, Ctenocephalides felis
aatnaatggactgcgttatgaaaggactcaataaaatcacctgctgcttgctggcagcactactcatgccttgtgcaggacacgctgagaacgaacaatacggcgcgaacttcaataacgccgatatccgccagttcgtggaaatagtgggtcagcatcttggcaaaacgatcctgatcgacccttcggtncagggaaccatttccgtacgcagtaatgatacgtttagccaacaggagtactaccagttctttttaagtattcttgatctttacggttattccgtgatcacgctggacaatggttttctgaaagtggttcgctcagctaatgtaaaaacatcgccagggatgattgctgacagttctcgtccaggcgtaggtgatgagttggtcacccgaattgtaccgcttgagaacgttcctgctcgtgacctgcccccctgctccgcagatgatggatgcgggtagcgtcgtaatgttgtgcattatgaaccctccacgtcttattctgccggcgtgcctcaccattaataaactgnttgagcat

SEQ ID NO: 1801 - DNA, 549 bp, Ctenocephalides felis
gctnagcttttcaatatactttaagctaaaacagacgttgtaatgaatggagaaatgtgaaggatgaattacattctaataaaaatgattttaaaatatcatgctacgcatatcatctattatatgtatgtgattaatgccgaaatctgcacagcaaaacaaanaccaaaacatttatgtaaactagaatcaatatttgcttgtgtaattgcatatttattttgatagcccaatatagagtagatcgacttcgaaattacgaattacatacacacatgtatatatatatatatatatatatatatatatatatataatatgcataaatatacataaatatatgcntgtatatacacatgtataaatatagaattttacatatgtgtatatgagcatatatatatatatatattcttatttaacctcatatttataattaattatatggtaatcgcnaaaaaaaatgataacacaatgttttgtaaatcataaatcacatacgtactaaatatttagtatctggttttcatacanccctagncgtattat

SEQ ID NO: 1802 - DNA, 549 bp, Ctenocephalides felis
gctaacagttacaattaatttttaagtattgggcgttttattattgtattttaatatataattctatatttaaatcaattatgagtttgcctttagaaattagaagacttgacgaagcagtaattaacagaattgctgcaggagaaatcatccaaaggcctgcaaatgccttaaaagaattacttgaaaacagtctcgatgcaaaatccagtagtattcaaatttcagttaaatccggaggcttaaagtacttacaaatccaagacaatgggacaggaattcgcaaagaagatttggccatcgtttgtgagcgatttactacgtctaagctccaaaaatttgaagatttacaaagtatagccacctatggattcagaggtgaggccttagctagtataagccatatagcaagactttccatacaaacaaaaacagcagactccgttgtgctttcaaagcatcttacgaagatggaaattgaaatttccccaaccatgtgctggaaataaggacccaatacagtagaagacttttctatatactacagnt

SEQ ID NO: 1803 - DNA, 549 bp, Ctenocephalides felis
gatctaaatcccagcttaataccggcatccacgcatagatgtttacacctgagcgggtacgtaattgccaggcaacccgactaaaaatatctgctttcattggtagcaaacgatttggaaaccagacctctttgaccagcccatcaccatcgggatcagcaaatgcctgcaaatacacggttgatatttgcatatctttcacccgctgaattagcacatcaatattgcgatccatttgctggaggttttcgtcataaacgtaatcaagatcgatatgcattatccgttgtggtgatttttcctgtacggtaataatttgctgggcaaactcttttaatgagggattattggcgattaatacccgcggaatggaatccaattgcgacgcatttgccaaacctgattcaagggtgagcccggtacccaattcgcctatagtgagtcgtattacaattcactggcgtcgtttacaacgtcgtgactgggaaaaccctgcgtacccaacttaatcgcttgagcacatcccctttcgcagctggcgtatacgaa

SEQ ID NO: 1804 - DNA, 280 bp, Ctenocephalides felis
aattctgcgatctgnnaggtgtgcgtaattgtcgcgatctgactgattttggcagagaaattcgcgcaacggtgctacaacgtacccatcttactgttggtgtggggatcgcccagaccaaaacgctggctaagcttgccaatcatgcggcaaaaaaatggcagcggcagacgggtggggtggtggatttatcaaatctggaacgccagcgtaaattaatgtctgctctccccgtggatgacgtctgggggattggacggcggatcagcaaaaaactgga

SEQ ID NO: 1805 - DNA, 528 bp, Ctenocephalides felis
gcgcccctatgagtgcagtatatgcaagaagacattcacacaatcgcgggctctgaaatctcacatgctcattcacaatggtgagcgcccccttgagtgcaatgtatgcaagaagacattcacacattttgttgttctgaaaagacacatgctcgttcacagtgattagcgtccccatgaatgcagtatatgcaataagacattcaaaggattaagttctctgaaagaacacttgcggattcatacaggagagcgtccttataaatgtgaaatatgcaataaggaatttactctattaagagttttgaagaaacacatggccattcatagtaggaagcgtgatgaaaatcagtgaaatatctgttaaattgtatttaaatatttggaaacatgttataaaatattcttacatataatagaatgtataattagataaaatatattttataaatatgtaataataaacattaaacatgcattattgtaaataaaggcaattgttcatattaaaaaaaaaaaaaaaaaaaa

SEQ ID NO: 1806 - DNA, 549 bp, Ctenocephalides felis
aataaccttattgctctactaaaaatatatataataatctctgattttgggacagaaataatttaaatattttagatagctttcaataaagaataactaatatagtatccaattaattagtctcctgtcagcatgtctacacgatggtaccctctttatcaaagaggcaatccacagctgagagtattcttaccaaatttctggttgaaattaataaggcctgttcatgaacaaccaccaaatgttgtgcaattcgcctgttccatgcaaatgacaaaatacgatataaaaaactatttagaaaaaatatacaatgttccaatcatagatgtgagaacaagaattcaattaggtaaaactaaacgagatttgaaaggatatattgtaaaagaagaagatactaaattagcttatgttacattgctaaagaagaagtattgaatttctaatatttcaaaaaagatgaagagagcagttcaagaagattgaaaagntgaatgaatcaaagaacttataaaatacctggaagaataaaatcaccgncaccan

SEQ ID NO: 1807 - DNA, 549 bp, Ctenocephalides felis
aattatgatgttgattnccatgaagatgctgataaagccaatcaggcactgaaagatgcggtagcggaattaatggaaaacgaagaaattcgcgggctgattattggtgaaccgaattttgccgggattgtcggnttaagcaataccgngtttacactgcgtgtttcgttcaccacgctgccactcaaacagtggacggtacgctttgccctcgacagccaggtgaaaaaacatttcgacctggcgggcgttcgcgcgccagtgcagacttatcaggtgctgtctgctccgggcgcgaccccggntgaaccgttaccgccgggggaaccaacgctttaacgctggcgattgacaaaaacgggcggcgctgtcgnngttcataaaggtcaaggcaataaagcactttgctttgccctgggcctctctttttacaccttcaccgcccancgtccgtaaggcacgnncaccggggntagtttnacaacgagatccagnatgtaaaccctaacctgcttcgnganncttggtttctcatattttttgnaaaag

SEQ ID NO: 1808 - DNA, 549 bp, Ctenocephalides felis
aatcaattaaatcacttaaacctgcgagtcatttcgtaattacattaattaaaaaacttaaaatcattaaataaataaaaaaccactaactctatgtgaaataaatcaaaatttcacgccgaaatactccttaggatgtatagcgaaaggagaaaaagatatacctcgatcaccccctttctcccaagtgaaaataaaaggttatcagtttgcaacattgaacaacattcgttgcaaatcgataacaacatgcaccttcaggatactatttattatgttcggcaatgatattttcacccgcgtaaaacgttcagaaaataaaaaaatggcggaaatcgcccaattcctgcatgaaaatgatttgagcgttgacaccacagtcgaagtatttattaccgtaacccgcgatgaaaagcttatcgcgtgcggtggaattgcggaaatattattaaatgcgttgctatcagtgaatccgccgcggtgaaggactggcgctgcattagccactgaattgataaacctcgctatgacggcacagcacgcttgtta

SEQ ID NO: 1809 - DNA, 549 bp, Ctenocephalides felis
ttgaaagcaaaatattattttggcactgactaaccctgacttttgctatgtcaattacctcagcagataaaaataattcataggaaagtgtaatttataacaaacgtcgcaatatatatttcacattttcaagatggaacaaaataattcagttgactggcaaatatcaagaaaagaagtaagacagagggctcaatatcttttagaaacagggcaatggtcagattgcaaatttttagttggttcagaatctaatcaacaagttgtggaggctcataaattatttttggctattgcctctccagtattcgaagctatgttttttggaaatatggctgagaaaaatgatacaattccaatattggatgtacagccagatgctttcaaggcattgttagaatatatctacacagacaacattaatataaactcttttgcaaagcttgtgaactgtgttattgtgcaaaaaagttatgttacccatttggtagagaaatgtcaaaattttatggctgactcatgctcgaaatgtgtaagcatatgaatttg

SEQ ID NO: 1810 - DNA, 549 bp, Ctenocephalides felis
gtttgaagaaaaaggaaatattgccgngcgagcagggcaggaagatcgaggcaaaggtcacggacgagctgataaggaggcttataaacgcggataaaattaaggaggcgaatgcggncagacccaaggcagaaagggccaagaaggaagcggctgcagcgaaggaaggggatgaatttgatcaaatggttgacggttccaagaagccactgaagcaacgaatcaaaaaggaagataaagataaagacaaggataaaatgaaacagactaaattagattttagtaaaaagggaaagaagaacaaaaagaaaggcgccagaaaggattcttttggcagcgaatcatcggatgaagatgatccggattcagattttgaagctcatgcatcttcagaatctcctaaaagacaattagcaagtcggggaactaaaaanccggtgaaatacagtctgcggagttcagatgaagaagaagagctgtttgacaataaacaaatggacagtgagccgtgtgtgtaccgtcttcagatctgattccgtgtgaacctct

SEQ ID NO: 1811 - DNA, 549 bp, Ctenocephalides felis
aatgaaatcagtctttatgccggttatcaggcaggaatatggtcaacatccccaatagtggcaggaaagcacagattttatagactaactcgatgctggtgtgatcggcgataagccccagaactgccgctcccagacctcccatgccaaaagcaaaaccgaaaaagagtccagaaaccataccgatacgtcctggaagcagctcctgagcgtagaccagaatggcagagaatgccgaagcgaggataaatccaataatcaccgttaaaacccccgtccagtgcaggctggcgtagggtaaaatcagcgtaaacggcgcaacgccgaggatagagccccaaatcacatatttccgcccaattttatcccctacaggcccgccgatcaccgtacctgccgcacggcaaacaggaaggcaaacagatgaagctgagcattctggatagataatccgaatttttgcatcagataaaaggtgtaatagctgtgtgctcgcatatagaaatatttcgagaaaatgaggattaacagatgctgccgcagtacaac

SEQ ID NO: 1812 - DNA, 549 bp, Ctenocephalides felis
atggctctcgcctctntatgccgacaagctcgctctctttctgtctatcagaacaaattcgctactcgtacgacgcgtcagtcttcgattgttcttgattcagttcgcgaattttcaaagaaaatgggtctgccacgagttttcttcgacatgaccgccgacggcgagccggttggaagaatcgttatggagcttcgtaacgatgtgacccccaagacctgtgagaacttccgcgccctctgcaccggcgaaaagggcttcggctacaaaggctcctcattccaccgagtcatccccaacttcatgtgccaagggggcgacttcacaaaccacaacggcaccggcggaaagtccatctacggaaacaaattccccgatgagaacttcaccttgaaacacaccggcccaggcatcatgtccatggcaacgcaggccccaacaccaacggatcccagttcttcatacgactgtcaagacacctggtggacaaccgcacgttgtctttggatcggttgagaaggatggatgtcgtgaagaagtggagagtat

SEQ ID NO: 1813 - DNA, 549 bp, Ctenocephalides felis
aatacgctttccacggttngcaaccatttaaatcggtaagtaaaacatcaacatattgcgtattcgggtagcgctccaggtagcgtttcacttcctgcgtaaaggcgctaccccgcctctcttctgactgctgaacaaagttctctacttcaacgatattggtttccatgattcttcgcctttggtttgtttttccgctcgttatcaaagcgtaaaatataatgaccaccattcgaatctgtatgcaaactaaatgtttgtcaaatgttaaattgagtttgcaaaaatgaaaacccactgctagattgaaaaaatattgaacataaaggtcatttaaagcgcngtaatggcgatnatttagtccactttgtgagattgagcatggaaaatataatgaacaatncggttatcgggtcgtaatgtgcangaacaggcttaagggtcatgcgacccagactctgaagaaangtacctgatgcntctccatgcaggcggttgctattngctncacatgcgctngcggaccgtnatacttgacaactttgccga

SEQ ID NO: 1814 - DNA, 549 bp, Ctenocephalides felis
ggcgcgcagtgacactgcgctggatcgtctgatgcagggggcaccggcaccgctggctgcaggtaacacggcactggtcggcgtgcaggtggactcggagcagttcggcagccagcaggtgagccgtaattatcatctgcgcgggcgtattctgcaggtgccgtcgaactataacccgcagacgcggcaatacagcggtatctgggtagatcgggtttcgccggatgatggcggaagttgtcatctctggcttggacggggcgtaccgcctgccgttaaccgtcgccgctgaaagggggatgtatggccataaaaggtcttgagcaggccgttgaaaacctcagccgtatcagcaaaacggcggtgcctggtgccgccgcaatggccattaaccgcgttgcttcatccgcgatatcgcagtcggcgtcacaggttgccgtgagacaaaggtacccggaaactgtaaaggaaaggccaggctgaaaaggccacggtcaaaaatcgnaggccagaataaagttaaccggggggatttgccnataactggta

SEQ ID NO: 1815 - DNA, 549 bp, Ctenocephalides felis
aattctgcgcggctttgattttgacggccaggaggcgctgaaagattctcgcgtgctgatagtgggcctgggcggcctcggctgtgcagcctcgcagtatctggcaagcgccggtgtcggtaacctgacgctgctcgacttcgacacggtttcgctctcgaatctgcaacgccagacactgcacagtgatgccacggtcgggcaaccgaaggtggaatccgcccgtgacgccctgacgcggatcaacccacatatcgcgattacgccagtcaatgcactgctggatgacgcagaacttgcagcattgattgctgaacacgatctggtgctcgactgtacggataacgttgcggtacgtaatcaactgaacgcaggctgttttgccgcgaaggtaccgctggtttccggcgcggcaattcgtatggaaggtcaaatcaccgtctttacttatcaggacggtgaaccgtgctatcgtgcttaccgttgttggtgaaaatgattaacctgcgtggaagcagcgtaatgcaccgtgatcgggtattggtcgtg

SEQ ID NO: 1816 - DNA, 549 bp, Ctenocephalides felis
atcaattcgtattagactttttgataaaaaatgctgtctaaagcttcgcttttggccaaggtatcccggccactgactgtggcagtgcgaacaacatcccaggctgcaacatgccctgctcctacaaaggtagaagaagccgatagtgctgaaagagatttggtcaacttcccaaggccaacacgtttggaacattcacctaaagttcgctttggattcattccagactcatggtttgaatttttctatgagaagaccggtgttactggaccttacatgtttggaactggtttaattacttacttatgttcaaaggaaatttacgttatggagcatgaattctatactggtatttcattgggtattatctgtctctatgccactaaaaagttgggtccacatattgcaaaatacttggacaaagaagttgatgcctatgccgatgaatggaattcaggtcgtgtagaagaagttaaaagttccaagatgccattgaaggagaaaagttggacaatggagagctgaagtacttatgttgatggatgcaaa

SEQ ID NO: 1817 - DNA, 87 bp, Ctenocephalides felis
aatttccagcgcgctcagtaccaccacgtcgagacgatcaaccgatgcgcctttcgaaccccagttagcgtactggttggcgctgat

SEQ ID NO: 1818 - DNA, 549 bp, Ctenocephalides felis
aaaaaacaaacgcagtttgctaccatttgcggtaaaaagttaattacaaacactacaaaaatgaaagcgttcatcgtagcagctttactgatcgccatggtggcagctcgtccccagaaagaagtggagatcctgcgttacgacagcgataacattggcgtcgacggttacaaattcgcctacgagctgagcgacggaaccaaccgccaagaagaagctcaattgcagaacgccggaaccgaaaacgaggcaatctccgtccgcggctcttacacctgggtggcacctgatggacagcaatacaccgtcaactttgtcgccgacgaaaacggttttcgaccagaaggagcacacattccgaaataaaaccaccaaattaaattagactactatgtatgatactcaaatgatacctgcattgaatatgtcatgtatgccaatatattaactgaattgataacttaatagatcaaaagcaatatatatatatatatatatatatatatatatatatcgcncaatgtntgtatcattataananttttatca

SEQ ID NO: 1819 - DNA, 549 bp, Ctenocephalides felis
aataccattttcaaaatcaccatattgcttcaaaaaatcgggatgtgtttccccaaaatcctctatatcttcccagccttctgcaccagaaataacggcacaaatagtcaacagtagaatatccgataatttatgttccactttccaggcttgtctgtaatcggggataatagaaatatgttccatcaattttttaagttccattttgttctccttaattatgtaagaagtatttgatcatgtataagcaataaaaaacagcttcaggtaataaggaatatctcaatttttaaacataaaatgcgaattatttagtacaaaaagcagggaaagattacgaaagcccgctccccgcaaggactgacgcgagggggggcccggtcccaattcgcctatagtgagtcgtattacaattcactggcgtcgtttacaacgtcgtgactgggaaaaccctgcgttacccaacttaatcgcttnagcacatcccctttcgcagctggcgtaatagcgaagaggccgaccgtcgccttccacagttgccagctgatg

SEQ ID NO: 1820 - DNA, 549 bp, Ctenocephalides felis
agtnnatctataaagtgacatatcaataaatatttatttagcactaagtgtttttgtttataaaatcttaaaaacaacaaccatggctcgttttatgattgctttatccctggcggttttaatcgtcgccgtaaccgccactccctacggtgccggaggacacggaagcagtggcggcggacacggctccgggcttgactccggttttggggggcacggaagccgcggcagtggacttggaggcagtagtttttccagtggtagccacggtggcggacttggaggtggaagcagaggccatggaggcctaggcggatctggaggttttggaggccaaggaggccttggtggtggacacggaggcgttggaggcggacatggaggtcacagtggcggaggacgtggaggacatggcggcagtcattctagatgaaatataaaagagaactctctgaaaatttgttggaatctgtgattccgtctttatccaccagaaattaattaaaaatttgaattaacaatgaataatatgtatttttgataatttga

SEQ ID NO: 1821 - DNA, 549 bp, Ctenocephalides felis
cccatggtatggagggantgggacctgaacattcttctggacgtttggaaagatttcttcagctctcttcagatgatcccgattatttccctccagaatgcgaagaatttgctgttcgacaattgcatgatatcaactggattgtagccaactgcacaacacctgctaattattttcatattttacgtagacaaattgctttacctttccgtaagccattgatcattatgactccaaaatcgttgttgagacatccagaagctaagagttcttttgatcaaatgacagagaacactgaatttatcagaatgattccagaagaaggaccagcagcatcagatcccagctctgtcaagaagttaattttctgctctggtaaaatctactacgacttgaccaatgcgcgccgtgaaaagaaattggataattctattgcaattgctagagtagagcaaatttctcctttcccatatgatttgataaagaaagaatgtgcgaaatatctaatgcaaatcttgatggctcaagaagagcaaaagacatgggtgc

SEQ ID NO: 1822 - DNA, 549 bp, Ctenocephalides felis
gctatcttgcggacaacaccgttgcgagagcaactgtcacaagggacgttgtgacccatgctggcgttcaagttttgatgagctgacatgtgaatgtggctacagcataaggtatccacccattccatgtggcgcccgcaaaccaacttgtgatcaagtttgctcaagacaacactcatgtagtcatcccgttcttcatacatgtcatagtgaagccgaatgtccaccatgtaccgttctatgttccaagtggtgttttggtaaacatgagatgcgcaaaactatcccctgccaccaaaaggatttttcatgcggccgtccatgcggaaaagaattaccatgtggtaagcattcatgtctattgccctgtcacaaaggtgcatgtctacaagacgggaagacctgtagtcaaccatgtgctacgcctcgttcttcttgcaatcatccttgtcgtacccttgcatgaaggtatttgccagacacaccttgaaagaaaaggattggtcatgtaatgtaaactcgtcccaccagacatgtcagaaacgtcgc

SEQ ID NO: 1823 - DNA, 549 bp, Ctenocephalides felis
aaaacccgacgaactgnaaaaaccgccgcgccagatatcctcttcgcgtaccacttgtttcagtcggccatattccgcaaaggcgacctcacgaatatccgccttgccaggctcatcttcaccgccaataaaaccaatacgattaacgccctggttgatatagaagtcgatgatttctttactgatgcgtgccagatcgatatccaccgcatcgtaaccgctgccgggttcgtgaaagtcgataaaacagatattgtcggtcaacgcgctggcagcggcgcgcagggcgggcgtgggtttgccgacaattaaaataccggtgacgtttttaatgtctggtaagccgctgtgttcataacagttggtgagctcgatgcccagcttttcgcactgggtttcaatgccgtggcggatcgcagatagtaaggatcgtgatctccagctcctgtggagctgtagatagccagaatatgggttggtgactgacctgttggagttacggcactactggcttgactcanttttcgggatctcgnaatgcgatgttcn

SEQ ID NO: 1824 - DNA, 549 bp, Ctenocephalides felis
gtcgaactacacgttttggcgacagatttttcgtacattgtcaataattaatattttaacaaaagcgaatacagtgaacggtcagtgatttttatgttatccgttaacgtaattcacttgtgatacaaagcaataggccgtcaaaacaaccgtgcgggtataatggcagcactccctcggcgtataataaaagaaacacttcgactaattcaggagccagtgccgggaatcagtgctattccggatgacagtaatgcacgctattttcatgtcgtcgtagccgggcccgaggactctccattcgaggggggctcatttaaactagaattatttttacccgaagactaccccatgtctgcgcccaaggtcagatttatcacgaaaatatatcatccaaatattgacagactaggtcgtatctgtttggacatactgaaagataaatggagccccgctcttaaatcagaacggtactcttatcaatacaagccttactgagcgccctaatccagatgatcctttggcaatgatgtggtgatgtggaagtaa

SEQ ID NO: 1825 - DNA, 549 bp, Ctenocephalides felis
aattcggtaattaattcttaacatgcttttactaataatctcaattgctggccctataatattgcgctagcattgctttctggttgtatcagcgatactcaaaaattcttaatacaatactcattcgactggtacttatttgtaactcagttatattttttcgcccggtgattcagaagaatgcaaaaaacggctaccactccatcaaaaatacttgatctcactgccgcggcatttttacttgtcgcctttctgacgggtattgcgggcgctcttcagactcctaccctaagtatattcctcgcagatgaactgaaagcccgtcctataatggtaggttttttcttcaccggtagcgctattatgggaattctggtcagtcaatttctggcaaggcactccgataaacaaggcgaccgtaaattactgattctgctatgttgcttatttggagtgctggctgccgctttttgcgtggaatcgcaactacttcattctcctctcaacgggcgtcttctgagtagtttgttcaccgaaacccgaaatgtc

SEQ ID NO: 1826 - DNA, 541 bp, Ctenocephalides felis
aaggnggtttagtaatattagccaatatggcaaagtatttagggctagataaagtcgctcgcttatttaggattgtgtctgctaatggcggaattagaggaagtcttgcaaaactggcaagaacagatgatttaaaactgggcactctagtaggagaagacaaatacggtaataaatattatgaaaataatgaatacttctacggacgtaatagatgggtcgattatgctccacatgttggattaaattatgatgcctcccaagtgtgtcctgagtggtttggttggctccattacaaaacggatcttcctccaacaaaagatccagccagagcgcatcataaatggatgtcgaatcatagtgaaaacttatctggaacagatcgtcaatatgttccatattccactactgttcccaaaatcaggcatggaatcccaatgcaaaataagtcatgaaaattttggatttacttagtctaattgtaataatgtaattctatttaaaattatggacaagatcaagttaaaaaaaaaaaaaaaaa

SEQ ID NO: 1827 - DNA, 549 bp, Ctenocephalides felis
ggaagtcggactcggcacaaagaccgacttttgccgaagcccggcacgatctgaccgccctgcaccgtgcagagtctgccgccctggacgccatggacgatgcctcaacgacggactgttttgatgtcagtggattcagcgaggactacgaaaatggagttgtgtattttgataggcggatttcggaatttgaatgtgatatttgatttaggctcaaattgcacatcgggaaaatcaaattattatctagctttgtgcaattgggagggaacatcgatttgcagatactttcttgagcaaatatttttatatttatcaaatgcatagtatggaaaagtctctagatactttggtctagtacctggattatagcgaaattagccaaattttcaattatataaacagaaaattatttaggctcaaattgcacattggcattgaatttgccgaaattgattttctagcttcgtataattgtattagaagcattgatttttttttggaatacaaaaaggcgtcaagtgaaggaaaaattgatttggagatata

SEQ ID NO: 1828 - DNA, 549 bp, Ctenocephalides felis
cacaagacatgtcagctgagtcttagtccttcgtctgctgctaaaagtatattagaaaatcttgtatttttaatatttgtgtttgattttccagtcggttacgttatatacattatcacagaatcatggggcaagattcgggagtaaaggattttccttctttgcctgaagacaaaatagatatgattgctgctaccagcttattacaacaacatgctgcggatatccgtcagcaaaaaattaactggacatcatacttacagtctcaaatgatcactcaagacgactttaatttcataagtgcttatgactctactgattctaagggccgcataaggcttctcacagatcgcactcaagcagctaaaacatttttgaacatcctaacacatgtcagcaaagatcaaacaattcaatatgttttaattttgattgatgacatgctgcaggaggatagatccgtgtcgatattttccatgagtatgctgtaaaaccaagaaagtgatgggcccttcatgaattattgatcgcagacagttcattgtacat

SEQ ID NO: 1829 - DNA, 549 bp, Ctenocephalides felis
ggcctcgttcgccgcctgcaatgccccggcttcatcgccggaacgctgcaactgagcaacatacgcaatctgctccgccgacacgttatggaactggcgagccatcgccgtcagccccgacgtcgggtctgtggtcagcttcccgaaggcttcagcgaccttgtccacctccacgccggatgcagaggagaaacgcgccacactctggctgatggacgcaatctgagcctcaccgcttacccccgccttaaccagtgcgctgagtgactcgctggtctggttaaacgtcagccctgccgcctgcccggctctggacaggaccagcatacgatctgccgtcagtcccgctgattgccggaaaggaccagcgttttgttgaaatcggacagggttgagttgcctgataccaggcatacgccagcgcaccggtcgcaccgcagcgaggtggccccacatcggcagggtgatcgaccggcaagccccctgaacatggggatatccgccgaaggagtcttacctgccccctgtgcanaggatagcacggatttg

SEQ ID NO: 1830 - DNA, 549 bp, Ctenocephalides felis
aagtgtcagggcgtcttaaggatcatttggacttcttaattaatttccaaataatggctgatgcaaccgaaggaaacattgaaaaactatctaaaaatgagctcaaaaggaggttgaaagcagagcaaaaggcaaaagaaaaagctgaaaaggcagcagctgtaccagaaaagcctgtaaaagaagccaaaaaggaagtaacaaaagttgatgaagaaattagcccaaatgaatattttaaactccgaactgctgcagtaactgcattaaaaaattcaaatgatcctgatcagcatccttatcctcataaatttcatgttagcattggtttgactgagtttatagagaaatacaaggatcttcaggatgcgcaaatattggaagatgttactttgtcagttgncggaagagtgccgccatcagggagtctggagctaaacttgtattttatgattgaggggagaaggtgtcaaaattcaagttatggcaaatgcaaatattagttctgaggaaaaatccagaagacacatcgaaatccgcgtggtgtat

SEQ ID NO: 1831 - DNA, 549 bp, Ctenocephalides felis
aatcgcggcggtgatcattgagccgattgtccagggcgcaggcgggatgcgcatgtaccatccggaatggttaaaacgaatccgcaaaatatgcgatcgcgaaggtatcttgctgattgccgacgagatcgccactggatttggtcgtaccgggaaactgtttgcctgtgaacatgcagaaatcgcgccggacattttgtgcctcggtaaagccttaaccggcggcacaatgaccctttccgccacactcaccacgcgcgaggttgcagaaaccatcagtaacggtgaagccggttgctttatgcatgggccaacttttatgggcaatccgctggcctgcgcggcagcaaacgccagcctggcgattctcgaatctggcgactggcagcaacaggtgggcccggtacccaattcgcctatagtgagtcgtattacaattcactggcgtcgttttacaacgtctgactgggaaaaccctgcgttacccaacttaatcgcttnacacatcccctttcgcagtggcgtatagcaaaggccgaccgatcgcct

SEQ ID NO: 1832 - DNA, 549 bp, Ctenocephalides felis
aggacaacatcagagtttgaaattgtacgcagcattaaagaaaaagcctgctacttagctagtaatcctcaaaaggaagaaagtgtagacacagaaaaaattcaatatgttcttcctgatggttacccattagatattggtccagctagatttagagctccagaagttttattcagacctgatctaatcggtgaagaaagtgaaggcttgcatgaagttcttttatattctatcgaaaaagctgaacgagatttgaggaaagtattgtttcaaaacattgttttatcaggtggttctactctatttaaaggctttggtgacagactgttgtcagaaattcgaaaacaagtaccaaaagatatgaagattaagatttctgctccacaagagcgtttatattccacctggataggaggttccatttagcttcattagatacattaagaaaatgtgggtttctaagaaagagtatgatgaagatggcaaagagctgtcatagaaaacttctaataatagcattgcttctcactcantaatattaaggtattt

SEQ ID NO: 1833 - DNA, 549 bp, Ctenocephalides felis
tgccattccgccacggcgatattttacacgtgacgaacgccagcgacgacgaatggtggcaggctcgccgggtacctcctccaggaggngctgatgaaggtacggntggcatagttccttctcgcaaacgttgggagaggaaacagaaggccagagatcgcagcgtcaagttccagggacaacagcctggacaagttggggataagcaaagcacgctcgataggaagaagaaaaataactttgcattcagcagaaagtttccatttatgaagtctaaagatgataagagcgaggatggatctgatcaggaacgcgaagaaaacgttctttcttatgaagctgtgcaacaattgactataaattcaccagaccagtcataatattaggaccgctcaaggatcgcgtcaatgatgatttgatttccgaatttcccgaaaaattcggcagctgcgtcctcatactacaagaccgaagagaggtatgaagtggtggcgagatatcacttctggcatccgcgaacaaatggacgtgatatcaaatattgttatt

SEQ ID NO: 1834 - DNA, 549 bp, Ctenocephalides felis
aatttcgtgcagcagangtaaataaatctggcggagcctgggagctccgccagagccgttaaacagctggcatattgcgcccgtaataaatctcgcgcatttctttccacagcgcagcggtaatttcctggcgctcgctgtcggttaagtcttccggtttggtgtggaacatgtagtgcttaaggtcgaactctttaagcaacatcttggtatggaagatattttcctgatagacgttcacatccaccatgtcatacagcgccttcatatcgtcagacataaagttctgaatcgaattaatctcatggtcgataaagtgcttcataccgttaatgtcgcgggtaaaaccgcgcacgcgataatcaatggttacgatatcggactcaagctggtggatcaggtaattcagcgccttcagcggagaaatcacgccgcaggtagagacttaatatcgggcggaaggacataaaccgcttaggatgactttcnggtaggatgtcgcaaatatgactttataagatggcacgaccgtttgcagtggccgggtgt

SEQ ID NO: 1835 - DNA, 549 bp, Ctenocephalides felis
gtggcttcggctttgataacttcctcaagattattcattttgattgtggtaaaaaatgccttctttaaacttgagcgaaaatgatcgtgctgtgttaaatagtatatttaatccgtctcaaccattaggagaaaatgcattcgaggaagatattccagaattattagaagatcaagaagacccggaaacaccatttttgaacgacgcacgagccttggaagctgaagctgtccgtttggccgaagccggggatttggcagccgcgctgaccgtggtggaccgcgcgatagacctgctgcccggtcgtccttcaggttacaacaatcgcgcacaagttcacaggctggcgggacgagaccaagatgctttgtcggatttaactatggctgtgaacctcagctccggaaaaggaagatctggtgtgcaggctttatgtcaacgggcctctgtcagaaaaactggtgaagacgattagctcgggaagatttaacaaagcgaagcttagctcacttgcaaaaatcagtagtggaatgaatcttatntgnttat

SEQ ID NO: 1836 - DNA, 549 bp, Ctenocephalides felis
ctttactccgagcaagtngtgggacgactcattattatttattttgtgataatcttttaaatctcctaaaatgaggatctacaaagacatcattactggtgatgagatgttctcagacacatataaaataaagttggtcgatgaagttttgtacgaagtgaccggcaaattggtttcaaggtctcaaggggatatccaaattgaaggtttcaacccatctgctgaagaggctgatgaaggaactgaaacagccacggaatctggtgttgatgtggtcttaaatcaccgcctttgtgaaacttttgccttctcagataaaaaatcatacactctttatttaaaagattatatgaaaaaattggtggcgaaattagaggagaaatcaccagaacaagttgaggtattcaaaacaaatatgaacaaagtcatgaaagaaatttaagccgtttaaagaaatgcaaatgttcactggtgaatcaatggttgtgatggcatggttgctcttatggaatatcgtgaaatagatggtgaatctgtcaattctgtgtc

SEQ ID NO: 1837 - DNA, 549 bp, Ctenocephalides felis
gttcaaataattctttatgttttaaacaatcgttatagtttaatagatggtcagttataaatttagcgtttatctattgttatttgttactcgttagttagtattattttaagtaggattcagtgagtgatatttgtgaattactcgaaacacatacatatataaactcagaataatgggaactcgagatgacgaatacgattatttgttcaaagtggtgctaataggagactcgggtgtaggaaaaagtaatttgctttctcgcttcactagaaatgaatttaatcttgagagtaaatccacaattggagttgagtttgcaacgaggagtatacaggttgatggtaaaacaattaaggcgcaaatatgggatactgctggccaagaaaggtatagagctataacatccgctattatagaggagctgtggtgctctcttagtttatgacattgcaaagcacccaacttatgaaaatgtagaacgtggtncgagagctaagagatcatctgacagaattagtgtatgctgtgggaaacaaattgtctgaa

SEQ ID NO: 1838 - DNA, 549 bp, Ctenocephalides felis
attttttttgccgggtcgtagtaaccaatttaaggataatggctcctccaccatacgcagacttgggaaaacaagctagggaggtatttaacagtggctatcattttggtcttttcaaattgaatttgaaaactaaaactgcctctggggttgaattcacttcaggaggaacttntgaacatgaaactggcaaggtatttggatctttggagacaaaatacaaagtaagtgattacggtctcactttttctgaaaaatggaacacagacaatactttagctacagaagtttccatacaagatcaaatagctaaaggtttgaaagtatcattcgactgctctttcgcaccacaaacgggaagcaaaactggtgttttgaaaactgccttcttacatgatagtgttgcagtaaatgctgatgtaaatttgaatttatcaggacctttgatcaatgccagcgcagtagttggtatcaaggatggtggcggtataaactggatttgntctgaaattcaaggcacaaagacactttgccttggatctcacagga

SEQ ID NO: 1839 - DNA, 549 bp, Ctenocephalides felis
attaaaatattattgttntaattgaattttgagttggttttgagaagctagtgccatgtttgattcaaggattactgtcggtttgctgctgacaataagctgttacttagtgtcgtccctgccccaaagaggaggattccaacctcaggctccaggaaaccaaataccaattttacggtattcattcgaacctaatccagatggttcctacaattacaactatgaaactggaaatggaattcaagtagaagagcaaggttacttgaaaaatgctggaaatccacaaacagaagctcaggtgatgcaaggttcctactcctacacgggccccgacggagtcgtctacacggtgaaatacatagccgacgaaaacggtttccgggccgaaggcgcccacataccctcggcaggaggacccgcaaggcggcgcccggcggtagattttctaggaaggaaaacatctagncccaccacaacattttaattatgaaaaacacagcgccatgatgcgagtcgaggaacaatggactataataattaatctncgng

SEQ ID NO: 1840 - DNA, 549 bp, Ctenocephalides felis
gccaacttgtatgccacgtcgaaaacactaaaaacaaatcgaattaaataaaattataaaataaaacaaatataataacaaagtattaaaacgtgtgatatattatttatattattattattatcaaaagtgtgagaacgtacaacgctcttgttaattttccagacaggaatttttagtgttgccatatatataagcgcgaggaaagatttacatacaagatgggttgcggaatatcgttcgttaaatacgttctgttcgtgttcaatttaatatttgcgctatgcggtctcgcagtgctcgccgttggcgtggtcttcaaattgaagttctcagagatccagcaaatgctccaggacttaaacgtccaggccgcaccaatactcttcatcaccgttggaagcatagtcttcataatcgcttcttcgggtgctgcggagcgattagggaaagtcattgtatgacagtcacttcgcagtcttttaatcgtttgctgacgccaagtcgtgatcgcgctgtgtcttcgctatgcgtgcatcaacaagatct

SEQ ID NO: 1841 - DNA, 549 bp, Ctenocephalides felis
aattaaacgtgcactggaaggcggcataaatttctttgataccgccaacagttattctgacggcagcagcgaagagatcgtcggtcgcgcactgcgggatttcgcccgtcgtgaagacgtggtcgttgcgaccaaagtgttccatcgcgttggtgatttaccggaaggattatcccgtgcgcaaattttgcgctctatcgacgacagcctgcgacgtctcggcatggattatgtcgatatcctgcaaattcatcgctgggattacaacacgccgatcgaagagacgctggaagccctcaacgacgtggtaaaagccgggaaagcgcgttatatcggcgcgtcatcaatgcacgcttcgcagtttgctcaggcactggaactccaaaaacagcacggctgggcgcagtttgtcagtatgcaggatcactacaatctgatttatcgtgaagaagagcgcgagatgctccactgtgtatcaggaggcgtggcggtattcatggacccgctgcaagggccgttgaccgtcgtgggagaactccgacgntgngt

SEQ ID NO: 1842 - DNA, 549 bp, Ctenocephalides felis
aatatcgccctgaaccntcgaaacctgaatggttttctccggttgnggggtaaaccactggatgtaacgcagcgggaagggaagggcaaacagcacgacggccaccaccagcggacgccagttgcgtttgaccaacgccagtgccagcaggccactaaccatcatcagcaggaagttaatggcttccacgcccattatcggtgccagcccttttaacgggccatcaatctggctatagccgaactgtaaccacgggaagccggtcagtacccaaccgcgcagaaactcggtcacttgccagagggcaggggcggcaatcgctacgcgcagccaggtggttttcggccacagacgcgacagcacgccagcaaacagtccggtatacagcgacaaatacgccgcagcagcaccaccaggaagatgttaaccgggccaggcattccgcaaaggtcgcgatgctgacatagacccagttatccgctgcaaagaggcnaatnccagcaaaagccaatagcggcagatggagtgacggcggtaaaggcaacgctg

SEQ ID NO: 1843 - DNA, 549 bp, Ctenocephalides felis
acttacttcaagtcaagcgtcatcgccgttcgtacccaaaacccaaacaagacttattgtgttcatttgtgttgtttagtgctgcatttgaggtcctcaatactatcttgaaataataaaatggctcgtactaaacaaactgcccgtaagtcgaccggtggaaaagctccacggaaacaattagctacgaaggccgcgcgtaaaagtgcgccatccactggaggcgtcaagaaaccccatcgttatcgtccaggtactgttgctcttcgtgaaatccgtcgttatcagaaatccactgaattgttgatccgaaaattgccattccaacgtttggtgagagaaattgcccaggatttcaagactgatctacgtttccagtcagctgctattggtgctctacaggaagccagtgaggcttatctcgtggcttatttgaagatacaaatttgtgcgccattcatgccaagagggtaacaattatgcctaaagatatccagttagcgcggcgaattcgtggtgacggctaaaatcggttataagaancaattt

SEQ ID NO: 1844 - DNA, 549 bp, Ctenocephalides felis
aatttctggtcagactttgaataccgactcaataaacacggctctgtattaaatgctgtattaatcatgctggcgcaacatgctctgcttatagcaatttcaagcgacttaaatgcatatggtgttgtgtgtgagttcgactggaatgatggaaatggtcaggaaggatggcctccaatggatggcagcgaaggaataagaattaccgatatcgatacatcaggaatatttgattcanatgatatgactatcaaggccgcctgagtgcggttttaccgcataccaataacgcttcactcgaggcgtttttcgttatgtataaataaggagcacaccatgcaatatgccattgcagggtggcctgttgctggctgcccttccgaatctttacttgaacgaatcacccgtnaattacgtgacggatggaaacgccttatcgcatacttaatcagcaggagcccaaagaatggatcaaacactatggtatccagactaaatcactatcgcctttatggcgataaaagatgttcgtnaaccgcaccttataaa

SEQ ID NO: 1845 - DNA, 549 bp, Ctenocephalides felis
aattcatccgttccgcatatattttgaggagctacaaccaggcgacagcctgttgactccccgccgcacaatgacagaggccgatattgttaactttgcttgcctcagcggcgatcatttctatgcacatatggataagattgctgctgccgaatctattttcggtgagcgggtggtgcatgggtattttgtgctttctgcggctgcgggtctgtttgtcgatgccggtgtcggtccggtcattgctaactacgggctggaaagcttgcgttttatcgaacccgtaaagccaggcgataccatccaggtgcgtctcacctgtaagcgcaagacgctgaaaaaacagcgtagcgcagaagaaaaaccaacaggtgtggtggaatgggctgtagaggtattcaatcagcatcaaaccccggtggcgctgtattcaattctgacgctggtggcaggcagcacggtgatttgtcgattaatcggtgaatgaaggnaacggcgaatagttgcctttatttcactaagtttggacgttgcacattatgcatgatg

SEQ ID NO: 1846 - DNA, 549 bp, Ctenocephalides felis
aggaagaagagatggangcctaccgcaaacagaccagtttggaaatcgagcaattgaacatgcgcgttgccgaggctgaaaccaaattgaagaccgaagttcaacgcatcaagaagaagctccagatccaaatcaccgaattggaattgtctttggacgttgccaataagactaacatcgatttgcagaagaccatcaagaagcaatctttgcagttgaccgagatccaggccgcctacgatgatgtccaacgccaattgcaagtgaccttggaccaattgtccgtctcccagagacgcgtccaatctttgactgctgaagtcgaggaagtgcgcagcaactacgaatctttgtcgcgcgccaaacgccaagtcgaacagcagtacgaggagagcgtcgccgcatcaacgagttgacggtaatcaacgtcaatttggcaagctcaagagcaagatcgagcaggaattgtcgctttgagcggagactcgagcaagtccccaggaattgagagtcagcgacgagagatccangcgtcagtcgactgaatca

SEQ ID NO: 1847 - DNA, 549 bp, Ctenocephalides felis
gtcttntaaatacatcatgaaaccttttgngggattannattgtgcctggcggtggtganctgcggtgatgtatccgaaaagaaacaagagaaacgcggactggccggnctcggcacgcacggaggcggtgccttactgtnatccgntggaggacacggnggnctcggtggaggatacggtggcggatatggaggtggttntggaggcggtctcggcggtggactcggcggtggatttggcggcggagcnnnattcggcggaggtgctggattnggcggaggattnggaggcggcngctggangtggnngcggtggcggtggtggcggngctggtcttggtggtccagtcacccttggcacacgcagtnacgaactactactgtgacacanggtattccatacgccgtccacaaccttacccantgactgtnacacgcaccgttggagtaccanccntcaaccnntnccnttgtncttccaagactgtncagnctctgtcctcaagtnaccagtgcagtcccctnaccngccatggttgnccnctgcnc

SEQ ID NO: 1848 - DNA, 508 bp, Ctenocephalides felis
gaancctaaaggtgaaggatacaaaggcagtaaattccaccgtgtcatcaaggacttcatgattcaaggtggtgacttcaccaggggagatggaactggaggccgctcaatttatggagaacgttttgctgatgaaaacttcaagttgaagcattatggtgctggatggttgtccatggcaaatgctggcaaagacactaacggatctcaattctttatcactacaaaagccactggctggttagatggacgtcatgttgtattcggaaaagtgattaagggaatggatgtggtgaggaaaattgaatcaacatcaacagattccagagacaaaccacaacgtgatgttgaaattgtagactctggtgctgaagctgtttctgaaccctacggtgtggctaaagaagatgcaactaattaaatgatttattaattttgataatttttaatcacttcaagacaaattgttctgataaataaaacattttttaaaaaaaaaaaaaaaaaa

SEQ ID NO: 1849 - DNA, 549 bp, Ctenocephalides felis
aattattggctgggtctnttaaactacaacaagggtaaaaaagatgatgcggcgtactattttgcttcggtagtgaaaaactatccgaagtcaccaaaggctgcagatgcgatgtttaaagtcggcgtcatcatgcaggacaaaggtgacaatgcggctggctaagtcgcgtttttcgtgttcatacacatacgacagcaccgcgaaaccttgcgtgccgtgctgctgggtggcctcttgcgccagggcgctacgcagaatgtcgcggatagcttcggaacggttgttataaccacgacgctggctcaggctgtccagcgtctccagtaaatcgtcatcaagcgtgatggtgactcgttgcatttgcgttaaaccttttctgtggtgcgacggcgcacggngaatgcgggtaataccgcgttttgtagcacacgtccggcgtcagaggaaaaggttaatttctctccaccactgggtttngacgattgtcgtgtcataacattacccgtggaaaagcgttctacagcgtagtcgtggtgatgacagnan

SEQ ID NO: 1850 - DNA, 348 bp, Ctenocephalides felis
taagcatttatgtatgactatgtaaaataaatgaatttatattttatcatttttctaattcaattataatgatgaagaataaaaaaaaattcatcttgtcaaagataacttaaaaaataattaaatataaatagatttatctaaaagcagttcgtcttatgagaatttatattgaaatgctatgttaacttgtatggccgtgttgtattttacaaaataaaacttcttacctaaagtggtgttggtagaagtgtttccaaaaccaaatgtgctagttgctggtttgttaaatgtattattaaataaagagtttgaagtagttgtttgaccaaatcctccaaaaccagt

SEQ ID NO: 1851 - DNA, 436 bp, Ctenocephalides felis
agcttgtcaaacttctnaataatatttccattcccaataattataaactaattagcctagacgttatatccctatttacaaatgtcccactagacttaatactagacgccatcaccagcagatggagtgaaaattaggccttcacaccacattatctttacattggtttagagaaatcatcaaattcattgtctctaacacctattttgaatttaatggatcattttattaccaaatttttggcaccccaatgggatctcccgcatctccgtctttagtagaaatttccttacaattagtagaaaacaaaatttttaataattataacaaacaaatcttttattaccgatatgtagacgatatcattcttgtattccggaagaagacattaacatatttactgataattttaacaatttaataaaaaactacagtt

SEQ ID NO: 1852 - DNA, 147 bp, Ctenocephalides felis
ngtaagaaccttcaatagcctcacggggtgttttgaatcctaatcctacattcctgtgaagacgtaaggatttcttttttaaaccgatcttgcggttgaggtttacacccaactgcttctggaaggctcgttcaagtctgatcagcc

SEQ ID NO: 1853 - DNA, 285 bp, Ctenocephalides felis; identical to SEQ ID NO: 1627

SEQ ID NO: 1854 - DNA, 261 bp, Ctenocephalides felis
ctaaatgaaattgtaattttaaatatgtaagaattataaaaaatagaagtaatatgatatattatcaaataataaaatgattaaaattaaagtattgatgataagaaaatttaataataattaataaaaaaaaatataactttaataaatgaatattttatcatcaacaaattacacaggaagaagttagaagtaaataataaaaaaatcttcagtaaactttccaagtattcgctcaggcgtattttagtaactttttgt

SEQ ID NO: 1855 - DNA, 332 bp, Ctenocephalides felis
atccttcagcacatttgcaaccaatataacattctctagaacaaggtccaggtaaatcgttcatgtagttagcacaagttcttggacaagaagtgccacaggaagtaaattcttcattttctgggcaagttgtgttcacagcaggcaaaggatcaacaaggtcttctggaagaatttcacctggaagagtttcttctggaagcgtttcatcacagtagacaaaagcagccaacacaaggcaactcaatacagtaactaatataactttcattttgtaacaaacttttcttcactctaaaatagatctaaaaattcaaatcgatcgatcgcag

SEQ ID NO: 1856 - DNA, 341 bp, Ctenocephalides felis
gagcatggtttggacgcagaaataagtctccacaagctatggctgcttgtgtcagtcgtgcttggtggcgttggcagcacaaatatattcacccaagaaaagctggaattgcaggattctatcaattgactgttggatcaatgattttgttctatgctttgaactacggcaagatctctgctcataagaactacaaataccactaaaaccaaacatcttacgatggtagtgtgtctgttgatggcagaataaatttctaaatgtaaaatctgtatcaatatacaattcaatatattaaattacacgagaaaaaaaaaaaaaaaaaaaaaaaaaaaaaaaaa

SEQ ID NO: 1857 - DNA, 238 bp, Ctenocephalides felis
ttctcatccaatcaaatttttctaatctttccataataatcggaagaacgagcattcccggtgcggccattactattcttgataaaacaacttgactgattccctttgcagcagctaaccgtgactttcctataatgcggccttcactatctacaacgtctattcctgctaataattctgtttgacgcatcatcggaatattaacgcaattagcagctgctactgcggcaaaaggaac

SEQ ID NO: 1858 - DNA, 263 bp, Ctenocephalides felis
ccaaattttattgtgatatnngtacacaanntgtganannttttgtggaancanaanangtantggtnttgcngttaantattataaggatactaatagtgatgttgtaagagttaggactaatagatgagtcttcttcaattttgataaacatatttttataatctgtgttaaattttgcacttgtaatgctgtgctttttaatgaataaacatgcaatattaaacttcgaaaaaaaaaaaaaaagttaattncttgcttgt

SEQ ID NO: 1859 - DNA, 613 bp, Ctenocephalides felis
agctgcccactatagggctaaagcggccgccngggcaggtgttggacaaaaatatttaaaattaagaagaaataaatgaaatatttataattattaaagaatcttgtatcgtgcaaaacataaatgatatataaattaatttcgatctcttaataaaagtattatttcaattaccttatttgatgagaaaatgcacaacaaaatcctggtcctggttgtttaccatgtcgtcctgatgtttaccatggtagtcgccaagactacacatgaagacaccaatgataattctacagacgtcttactggagttgcccaaatcgatgaacaatgatgaaaagttgttcctgacaactggtcaaattttggaagggactactgtatatagtgacgaattggcagatttcaatataacagaaaatacagtaaacgtaacagccgacaaagtagccctaaaagaaatcacacctgaccatcaccatccagtagtgacttctacacaaaaaacaattttaaacgcatccacgaccgttgaaaaaaatcctggacatcaaaccagtatttcagaagaatctaccacaaaattggtaaaaacaaccactgaagacaaccacctc

SEQ ID NO: 1860 - DNA, 613 bp, Ctenocephalides felis
gaggtggttgtcttcagtggttgtttttaccaattttgtggtagattcttctgaaatactggtttgatgtccaggatttttttcaacggtcgtggatgcgtttaaaattgttttttgtgtagaagtcactactggatggtgatggtcaggtgtgatttcttttagggctactttgtcggctgttacgtttactgtattttctgttatattgaaatctgccaattcgtcactatatacagtagtcccttccaaaatttgaccagttgtcaggaacaacttttcatcattgttcatcgatttgggcaactccagtaagacgtctgtagaattatcattggtgtcttcatgtgtagtcttggcgactaccatggtaaacatcaggacgacatggtaaacaaccaggaccaggattttgttgtgcattttctcatcaaataaggtaattgaaataatacttttattaagagatcgaaattaatttatatatcatttatgttttgcacgatacaagattctttaataattataaatatttcatttatttcttcttaattttaaatatttttgtccaacacctgcccnggcggccgctttagccctatagtgggcagct

SEQ ID NO: 1861 - DNA, 2739 bp, Ctenocephalides felis
  CDS (191)..(2206)
agctgcccactatagggctaaagcggccgccngggcaggtgttggacaaaaatatttaaaattaagaagaaataaatgaaatatttataattattaaagaatcttgtatcgtgcaaaacataaatgatatataaattaatttcgatctcttaataaaagtattatttcaattaccttatttgatgagaaaatgcacaacaaaatcctggtcctggttgtttaccatgtcgtcctgatgtttaccatggtagtcgccaagactacacatgaagacaccaatgataattctacagacgtcttactggagttgcccaaatcgatgaacaatgatgaaaagttgttcctgacaactggtcaaattttggaagggactactgtatatagtgacgaattggcagatttcaatataacagaaaatacagtaaacgtaacagccgacaaagtagccctaaaagaaatcacacctgaccatcaccatccagtagtgacttctacacaaaaaacaattttaaacgcatccacgaccgttgaaaaaaatcctggacatcaaaccagtatttcagaagaatctaccacaaaattggtaaaaacaaccactgaagacaaccacctcggtgtaaagagcctgaatgaacctggtgatgaacaagaattaaaaaaaccatcatcacatggtaaggagcatatttctttaccagtggcttcaccagtaccaccagtatcgcatatcttccaggctacaccaggagacctttgtccagccttcgacgatgcagatcgcttcacccagacagaacttttgtccaggctgacaaacgattgcaggtacgataagctggagcgccctttggggcctcacaatggtgcagggccgctcccggtggccgccagaatttacgtgtattttatacaaaatacggacgcgcacgaattgtcattttccgtgaccgtcctcctccaatttcgttaccaggacgccagattggcctacaaaaaagtggcacccaccaggacggtcatcatgggcgaatcgcagctcagggacaaaatctgggtaccacatgtattcgttgccaacgagagatcttcccaggttatgggcacagatgcccaatctaaggacatgttggtgtcagtagctcctgatggtacagtcgtcttttcggtcaggatgaaggcaactttgtactgttggatgaatttaaggaaatttccttttgatgaacaacagtgtcagatgatgttggaaagttggaagtacaatacaagtgaactcctattgacttgggaaccaactgcaccagtaactttagcaccagaactacatttgaccgaatatgtccttactgacatgtgggtaaatgaaacagttgtcaaggctgatttggatgacctgagacacggagcatttggtgggacatacagtgccttaagtttcacgattcaaataagtcgtgaaatgggttactatttaatggattactttttgccatcagtaatgatcgtgtcgtgttcctgggtaagtttttggctggcagcagaccaatcagcacccagagtcaccttaggtacaagcaccatgttatcatttatcactttagcaagtgcccaaggaaaaactttacccaaagtatcgtacatcaaagcttcagaaatctggtttttaggttgcaccgggtttatttttgggagtttagtggaattcgcgtttgtcaacacaatttggagacgaaggaaaaatgtggaattgaaaaaagtcaacagcaagtatattttgaagtcaactttgacgccgaggttggcccggaaggagtttcatgcttcgtttaattcgaatcctggaggtggtaataaggatgatcaggatttgggaagagggattagggtctttccgccgcctttggtcaaggctaggtcttgttccagtctggataggagtaatggatccgggaattttttgagcgtccatggaaatgatcacaaagttccaacaataacagcacaatgtgcagacgatgccgcaagtgaccagatttcagtttgtgtcgatggggaaaacgaagaacctgcacaaattgttcaccacacctggacgacgatgacacctcaagaaatttccatgtggattgacaaaaggtccagaatttgtttcccgatagcttttgctatatttaactttttttattggatatttgtttattatttataaacacacttaatatacttatagttttaataattaataaatttataaaataattaaaaataaatatatgtaaaatttaaaggaaacgtgaatagaatcaaaagagattcttattggattattccattattaataggattcttactagacaatattaatgattttatattatatatcacttataacttttgaacggtttgttaaaaatgaatacaatatttgacaaatttatataaaattaaacaatttataatattgtcgaacatcttaccaccctacagcgactcagtatactcgaaaatcgctattgaaatatcttacacaatttagtcattcctatttcacatataatagttaataattaaaattgaaattttaaattaaaaaataatgatactggaaattttaattttaattattaattattatatgaataattaattttactgcatagttataattataattataaatattaaatttttagaataaatactcagctggtctgaaaaaaaaaaaaaaaaaaaaaaaaa

SEQ ID NO: 1862 - protein, 672 aa, Ctenocephalides felis
MHNKILVLVVYHVVLMFTMVVAKTTHEDTNDNSTDVLLELPKSMNNDEKLFLTTGQILEGTTVYSDELADFNITENTVNVTADKVALKEITPDHHHPVVTSTQKTILNASTTVEKNPGHQTSISEESTTKLVKTTTEDNHLGVKSLNEPGDEQELKKPSSHGKEHISLPVASPVPPVSHIFQATPGDLCPAFDDADRFTQTELLSRLTNDCRYDKLERPLGPHNGAGPLPVAARIYVYFIQNTDAHELSFSVTVLLQFRYQDARLAYKKVAPTRTVIMGESQLRDKIWVPHVFVANERSSQVMGTDAQSKDMLVSVAPDGTVVFSVRMKATLYCWMNLRKFPFDEQQCQMMLESWKYNTSELLLTWEPTAPVTLAPELHLTEYVLTDMWVNETVVKADLDDLRHGAFGGTYSALSFTIQISREMGYYLMDYFLPSVMIVSCSWVSFWLAADQSAPRVTLGTSTMLSFITLASAQGKTLPKVSYIKASEIWFLGCTGFIFGSLVEFAFVNTIWRRRKNVELKKVNSKYILKSTLTPRLARKEFHASFNSNPGGGNKDDQDLGRGIRVFPPPLVKARSCSSLDRSNGSGNFLSVHGNDHKVPTITAQCADDAASDQISVCVDGENEEPAQIVHHTWTTMTPQEISMWIDKRSRICFPIAFAIFNFFYWIFVYYL

SEQ ID NO: 1863 - DNA, 2739 bp, Ctenocephalides felis
tttttttttttttttttttttttttcagaccagctgagtatttattctaaaaatttaatatttataattataattataactatgcagtaaaattaattattcatataataattaataattaaaattaaaatttccagtatcattattttttaatttaaaatttcaattttaattattaactattatatgtgaaataggaatgactaaattgtgtaagatatttcaatagcgattttcgagtatactgagtcgctgtagggtggtaagatgttcgacaatattataaattgtttaattttatataaatttgtcaaatattgtattcatttttaacaaaccgttcaaaagttataagtgatatataatataaaatcattaatattgtctagtaagaatcctattaataatggaataatccaataagaatctcttttgattctattcacgtttcctttaaattttacatatatttatttttaattattttataaatttattaattattaaaactataagtatattaagtgtgtttataaataataaacaaatatccaataaaaaaagttaaatatagcaaaagctatcgggaaacaaattctggaccttttgtcaatccacatggaaatttcttgaggtgtcatcgtcgtccaggtgtggtgaacaatttgtgcaggttcttcgttttccccatcgacacaaactgaaatctggtcacttgcggcatcgtctgcacattgtgctgttattgttggaactttgtgatcatttccatggacgctcaaaaaattcccggatccattactcctatccagactggaacaagacctagccttgaccaaaggcggcggaaagaccctaatccctcttcccaaatcctgatcatccttattaccacctccaggattcgaattaaacgaagcatgaaactccttccgggccaacctcggcgtcaaagttgacttcaaaatatacttgctgttgacttttttcaattccacatttttccttcgtctccaaattgtgttgacaaacgcgaattccactaaactcccaaaaataaacccggtgcaacctaaaaaccagatttctgaagctttgatgtacgatactttgggtaaagtttttccttgggcacttgctaaagtgataaatgataacatggtgcttgtacctaaggtgactctgggtgctgattggtctgctgccagccaaaaacttacccaggaacacgacacgatcattactgatggcaaaaagtaatccattaaatagtaacccatttcacgacttatttgaatcgtgaaacttaaggcactgtatgtcccaccaaatgctccgtgtctcaggtcatccaaatcagccttgacaactgtttcatttacccacatgtcagtaaggacatattcggtcaaatgtagttctggtgctaaagttactggtgcagttggttcccaagtcaataggagttcacttgtattgtacttccaactttccaacatcatctgacactgttgttcatcaaaaggaaatttccttaaattcatccaacagtacaaagttgccttcatcctgaccgaaaagacgactgtaccatcaggagctactgacaccaacatgtccttagattgggcatctgtgcccataacctgggaagatctctcgttggcaacgaatacatgtggtacccagattttgtccctgagctgcgattcgcccatgatgaccgtcctggtgggtgccacttttttgtaggccaatctggcgtcctggtaacgaaattggaggaggacggtcacggaaaatgacaattcgtgcgcgtccgtattttgtataaaatacacgtaaattctggcggccaccgggagcggccctgcaccattgtgaggccccaaagggcgctccagcttatcgtacctgcaatcgtttgtcagcctggacaaaagttctgtctgggtgaagcgatctgcatcgtcgaaggctggacaaaggtctcctggtgtagcctggaagatatgcgatactggtggtactggtgaagccactggtaaagaaatatgctccttaccatgtgatgatggtttttttaattcttgttcatcaccaggttcattcaggctctttacaccgaggtggttgtcttcagtggttgtttttaccaattttgtggtagattcttctgaaatactggtttgatgtccaggatttttttcaacggtcgtggatgcgtttaaaattgttttttgtgtagaagtcactactggatggtgatggtcaggtgtgatttcttttagggctactttgtcggctgttacgtttactgtattttctgttatattgaaatctgccaattcgtcactatatacagtagtcccttccaaaatttgaccagttgtcaggaacaacttttcatcattgttcatcgatttgggcaactccagtaagacgtctgtagaattatcattggtgtcttcatgtgtagtcttggcgactaccatggtaaacatcaggacgacatggtaaacaaccaggaccaggattttgttgtgcattttctcatcaaataaggtaattgaaataatacttttattaagagatcgaaattaatttatatatcatttatgttttgcacgatacaagattctttaataattataaatatttcatttatttcttcttaattttaaatatttttgtccaacacctgcccnggcggccgctttagccctatagtgggcagct

SEQ ID NO: 1864 - DNA, 2016 bp, Ctenocephalides felis
  CDS (1)..(2016)
atgcacaacaaaatcctggtcctggttgtttaccatgtcgtcctgatgtttaccatggtagtcgccaagactacacatgaagacaccaatgataattctacagacgtcttactggagttgcccaaatcgatgaacaatgatgaaaagttgttcctgacaactggtcaaattttggaagggactactgtatatagtgacgaattggcagatttcaatataacagaaaatacagtaaacgtaacagccgacaaagtagccctaaaagaaatcacacctgaccatcaccatccagtagtgacttctacacaaaaaacaattttaaacgcatccacgaccgttgaaaaaaatcctggacatcaaaccagtatttcagaagaatctaccacaaaattggtaaaaacaaccactgaagacaaccacctcggtgtaaagagcctgaatgaacctggtgatgaacaagaattaaaaaaaccatcatcacatggtaaggagcatatttctttaccagtggcttcaccagtaccaccagtatcgcatatcttccaggctacaccaggagacctttgtccagccttcgacgatgcagatcgcttcacccagacagaacttttgtccaggctgacaaacgattgcaggtacgataagctggagcgccctttggggcctcacaatggtgcagggccgctcccggtggccgccagaatttacgtgtattttatacaaaatacggacgcgcacgaattgtcattttccgtgaccgtcctcctccaatttcgttaccaggacgccagattggcctacaaaaaagtggcacccaccaggacggtcatcatgggcgaatcgcagctcagggacaaaatctgggtaccacatgtattcgttgccaacgagagatcttcccaggttatgggcacagatgcccaatctaaggacatgttggtgtcagtagctcctgatggtacagtcgtcttttcggtcaggatgaaggcaactttgtactgttggatgaatttaaggaaatttccttttgatgaacaacagtgtcagatgatgttggaaagttggaagtacaatacaagtgaactcctattgacttgggaaccaactgcaccagtaactttagcaccagaactacatttgaccgaatatgtccttactgacatgtgggtaaatgaaacagttgtcaaggctgatttggatgacctgagacacggagcatttggtgggacatacagtgccttaagtttcacgattcaaataagtcgtgaaatgggttactatttaatggattactttttgccatcagtaatgatcgtgtcgtgttcctgggtaagtttttggctggcagcagaccaatcagcacccagagtcaccttaggtacaagcaccatgttatcatttatcactttagcaagtgcccaaggaaaaactttacccaaagtatcgtacatcaaagcttcagaaatctggtttttaggttgcaccgggtttatttttgggagtttagtggaattcgcgtttgtcaacacaatttggagacgaaggaaaaatgtggaattgaaaaaagtcaacagcaagtatattttgaagtcaactttgacgccgaggttggcccggaaggagtttcatgcttcgtttaattcgaatcctggaggtggtaataaggatgatcaggatttgggaagagggattagggtctttccgccgcctttggtcaaggctaggtcttgttccagtctggataggagtaatggatccgggaattttttgagcgtccatggaaatgatcacaaagttccaacaataacagcacaatgtgcagacgatgccgcaagtgaccagatttcagtttgtgtcgatggggaaaacgaagaacctgcacaaattgttcaccacacctggacgacgatgacacctcaagaaatttccatgtggattgacaaaaggtccagaatttgtttcccgatagcttttgctatatttaactttttttattggatatttgtttattattta

SEQ ID NO: 1865 - protein, 672 aa, Ctenocephalides felis; identical to SEQ ID NO: 1862

SEQ ID NO: 1866 - DNA, 2016 bp, Ctenocephalides felis; identical to SEQ ID NO: 1864

SEQ ID NO: 1867 - DNA, 2080 bp, Ctenocephalides felis
  CDS (45)..(1868)
aaagtgatgcaacaattattttcaaaatacaaaagtgttaaaaaatgggcgttaaaaatatatatttatactgcattctgatatgcctgctacattatgcatcttataccaaaactgaatctattaccaacaattctttggaagaattgtacacaaacacttctgccaaaacagattccattactcttttatcaaaaaccagtctaccgcctgatcaaaatgccacgattgaaaatcctgatccagtgcttcctgaaaagggctccgctgaacaagaacaacacagctcgatgtctatattcttcgtgctttgtgtgctggctttagggattcttttaattcatttcatgttacaaacagggtttcagtatttacctgaaagtattgttgtagttttcttaggtgctttaatcggcttgataattaatttaatgtcgtctaaaaatattgcaaattggaagaatgaagaagccttttcacccacagcgtttttcttagtgcttctaccgcctataatatttgaatccgggtataatttgcataaaggtaatttttttcaaaatattggttccatcctggtgtttgctatatttggaacagccatatcagcctttgttgtcggtgctggtgtgtatttactaggaatggcagatgttgcttataacttaagctttgttgaatcctttgctttcggttcattaatttctgcagtagaccctgtagctaccgtagctattttccatgctttagacgtggacccagttttaaacatgttggtgttcggagaaagtattttaaatgatgctatttcaattgttttaacaactgcagttttggaatccaacaatcctttaatgacgactgctgaagctgtagtctccggtttaaataggttttgtttaatgttctttgcttcggctggtatcggtgtagtctttgccttaattagtgctcttttgttgaaacatgttgatcttagaaagtatccgtccttagagttaggtatgatgttggtgtttacttatgcaccttatgttttggcagaaggaattcatttatcaggtataatggcgatattattctgtggcattgtgatgtcccattacacacatttcaatttatcaacggttacacaaataactatgcagcagacgatgagaactttggcttttattgcagaaacttgtgtgtttgcttatttaggaatggctatatttagttttcgtcacagagtggaacctgccttagttatttggagcattgtactttgcttaattggaagagctgcaaatatatttcctttatcctggcttgtgaatcaatttagggagcacaaaatcactaaaaagatggcatttatcatgtggttcagtggtttgcgaggtgccatatcatatgcactttccttacatttagaattttctgatgaaacacgtcatgtaataattacaacgacacttataattgtactttgcacaacacttatattcgggggtgctacgatgcctttgctgaaatttttgcaggcgaacaagaagacccgttcagccacaagacgtacaagacgtcagcaaaaagcaataacattaagcaaaacccgagaatggggatcagcaatcgattcagaactactaagtgaattaacaaccgaagaagaacgtgacgtcacattcacccaagtaagacgaggcctagaattcatacgactggaccacaaatacttgagaccgtttttcactcgaagattcacccaccaggaattgaaggattgcaaaagtcaaatgacggatcttacgaataaatggtatcaaactataagagtgagtcctcagatgagtgatgatgatgacgttagtacgtgcagtacttaatttaaatttaaatttaatgctaattgaccaaaagtgttatgtgatatatataacagagttacctgtattttaatttatgttttaagttttaagataagtgcagatttgtcagtattttttctacaagggtagaatactgttgtatagctaatgtgtaaataaaaagtaataaatttgatttattgcactctaaaaaaaaaaaaaaaaaa

SEQ ID NO: 1868 - protein, 608 aa, Ctenocephalides felis
MGVKNIYLYCILICLLHYASYTKTESITNNSLEELYTNTSAKTDSITLLSKTSLPPDQNATIENPDPVLPEKGSAEQEQHSSMSIFFVLCVLALGILLIHFMLQTGFQYLPESIVVVFLGALIGLIINLMSSKNIANWKNEEAFSPTAFFLVLLPPIIFESGYNLHKGNFFQNIGSILVFAIFGTAISAFVVGAGVYLLGMADVAYNLSFVESFAFGSLISAVDPVATVAIFHALDVDPVLNMLVFGESILNDAISIVLTTAVLESNNPLMTTAEAVVSGLNRFCLMFFASAGIGVVFALISALLLKHVDLRKYPSLELGMMLVFTYAPYVLAEGIHLSGIMAILFCGIVMSHYTHFNLSTVTQITMQQTMRTLAFIAETCVFAYLGMAIFSFRHRVEPALVIWSIVLCLIGRAANIFPLSWLVNQFREHKITKKMAFIMWFSGLRGAISYALSLHLEFSDETRHVIITTTLIIVLCTTLIFGGATMPLLKFLQANKKTRSATRRTRRQQKAITLSKTREWGSAIDSELLSELTTEEERDVTFTQVRRGLEFIRLDHKYLRPFFTRRFTHQELKDCKSQMTDLTNKWYQTIRVSPQMSDDDDVSTCST

SEQ ID NO: 1869 - DNA, 2080 bp, Ctenocephalides felis
ttttttttttttttttttagagtgcaataaatcaaatttattactttttatttacacattagctatacaacagtattctacccttgtagaaaaaatactgacaaatctgcacttatcttaaaacttaaaacataaattaaaatacaggtaactctgttatatatatcacataacacttttggtcaattagcattaaatttaaatttaaattaagtactgcacgtactaacgtcatcatcatcactcatctgaggactcactcttatagtttgataccatttattcgtaagatccgtcatttgacttttgcaatccttcaattcctggtgggtgaatcttcgagtgaaaaacggtctcaagtatttgtggtccagtcgtatgaattctaggcctcgtcttacttgggtgaatgtgacgtcacgttcttcttcggttgttaattcacttagtagttctgaatcgattgctgatccccattctcgggttttgcttaatgttattgctttttgctgacgtcttgtacgtcttgtggctgaacgggtcttcttgttcgcctgcaaaaatttcagcaaaggcatcgtagcacccccgaatataagtgttgtgcaaagtacaattataagtgtcgttgtaattattacatgacgtgtttcatcagaaaattctaaatgtaaggaaagtgcatatgatatggcacctcgcaaaccactgaaccacatgataaatgccatctttttagtgattttgtgctccctaaattgattcacaagccaggataaaggaaatatatttgcagctcttccaattaagcaaagtacaatgctccaaataactaaggcaggttccactctgtgacgaaaactaaatatagccattcctaaataagcaaacacacaagtttctgcaataaaagccaaagttctcatcgtctgctgcatagttatttgtgtaaccgttgataaattgaaatgtgtgtaatgggacatcacaatgccacagaataatatcgccattatacctgataaatgaattccttctgccaaaacataaggtgcataagtaaacaccaacatcatacctaactctaaggacggatactttctaagatcaacatgtttcaacaaaagagcactaattaaggcaaagactacaccgataccagccgaagcaaagaacattaaacaaaacctatttaaaccggagactacagcttcagcagtcgtcattaaaggattgttggattccaaaactgcagttgttaaaacaattgaaatagcatcatttaaaatactttctccgaacaccaacatgtttaaaactgggtccacgtctaaagcatggaaaatagctacggtagctacagggtctactgcagaaattaatgaaccgaaagcaaaggattcaacaaagcttaagttataagcaacatctgccattcctagtaaatacacaccagcaccgacaacaaaggctgatatggctgttccaaatatagcaaacaccaggatggaaccaatattttgaaaaaaattacctttatgcaaattatacccggattcaaatattataggcggtagaagcactaagaaaaacgctgtgggtgaaaaggcttcttcattcttccaatttgcaatatttttagacgacattaaattaattatcaagccgattaaagcacctaagaaaactacaacaatactttcaggtaaatactgaaaccctgtttgtaacatgaaatgaattaaaagaatccctaaagccagcacacaaagcacgaagaatatagacatcgagctgtgttgttcttgttcagcggagcccttttcaggaagcactggatcaggattttcaatcgtggcattttgatcaggcggtagactggtttttgataaaagagtaatggaatctgttttggcagaagtgtttgtgtacaattcttccaaagaattgttggtaatagattcagttttggtataagatgcataatgtagcaggcatatcagaatgcagtataaatatatatttttaacgcccattttttaacacttttgtattttgaaaataattgttgcatcacttt

SEQ ID NO: 1870 - DNA, 1824 bp, Ctenocephalides felis
atgggcgttaaaaatatatatttatactgcattctgatatgcctgctacattatgcatcttataccaaaactgaatctattaccaacaattctttggaagaattgtacacaaacacttctgccaaaacagattccattactcttttatcaaaaaccagtctaccgcctgatcaaaatgccacgattgaaaatcctgatccagtgcttcctgaaaagggctccgctgaacaagaacaacacagctcgatgtctatattcttcgtgctttgtgtgctggctttagggattcttttaattcatttcatgttacaaacagggtttcagtatttacctgaaagtattgttgtagttttcttaggtgctttaatcggcttgataattaatttaatgtcgtctaaaaatattgcaaattggaagaatgaagaagccttttcacccacagcgtttttcttagtgcttctaccgcctataatatttgaatccgggtataatttgcataaaggtaatttttttcaaaatattggttccatcctggtgtttgctatatttggaacagccatatcagcctttgttgtcggtgctggtgtgtatttactaggaatggcagatgttgcttataacttaagctttgttgaatcctttgctttcggttcattaatttctgcagtagaccctgtagctaccgtagctattttccatgctttagacgtggacccagttttaaacatgttggtgttcggagaaagtattttaaatgatgctatttcaattgttttaacaactgcagttttggaatccaacaatcctttaatgacgactgctgaagctgtagtctccggtttaaataggttttgtttaatgttctttgcttcggctggtatcggtgtagtctttgccttaattagtgctcttttgttgaaacatgttgatcttagaaagtatccgtccttagagttaggtatgatgttggtgtttacttatgcaccttatgttttggcagaaggaattcatttatcaggtataatggcgatattattctgtggcattgtgatgtcccattacacacatttcaatttatcaacggttacacaaataactatgcagcagacgatgagaactttggcttttattgcagaaacttgtgtgtttgcttatttaggaatggctatatttagttttcgtcacagagtggaacctgccttagttatttggagcattgtactttgcttaattggaagagctgcaaatatatttcctttatcctggcttgtgaatcaatttagggagcacaaaatcactaaaaagatggcatttatcatgtggttcagtggtttgcgaggtgccatatcatatgcactttccttacatttagaattttctgatgaaacacgtcatgtaataattacaacgacacttataattgtactttgcacaacacttatattcgggggtgctacgatgcctttgctgaaatttttgcaggcgaacaagaagacccgttcagccacaagacgtacaagacgtcagcaaaaagcaataacattaagcaaaacccgagaatggggatcagcaatcgattcagaactactaagtgaattaacaaccgaagaagaacgtgacgtcacattcacccaagtaagacgaggcctagaattcatacgactggaccacaaatacttgagaccgtttttcactcgaagattcacccaccaggaattgaaggattgcaaaagtcaaatgacggatcttacgaataaatggtatcaaactataagagtgagtcctcagatgagtgatgatgatgacgttagtacgtgcagtact

SEQ ID NO: 1871 - DNA, 1824 bp, Ctenocephalides felis
agtactgcacgtactaacgtcatcatcatcactcatctgaggactcactcttatagtttgataccatttattcgtaagatccgtcatttgacttttgcaatccttcaattcctggtgggtgaatcttcgagtgaaaaacggtctcaagtatttgtggtccagtcgtatgaattctaggcctcgtcttacttgggtgaatgtgacgtcacgttcttcttcggttgttaattcacttagtagttctgaatcgattgctgatccccattctcgggttttgcttaatgttattgctttttgctgacgtcttgtacgtcttgtggctgaacgggtcttcttgttcgcctgcaaaaatttcagcaaaggcatcgtagcacccccgaatataagtgttgtgcaaagtacaattataagtgtcgttgtaattattacatgacgtgtttcatcagaaaattctaaatgtaaggaaagtgcatatgatatggcacctcgcaaaccactgaaccacatgataaatgccatctttttagtgattttgtgctccctaaattgattcacaagccaggataaaggaaatatatttgcagctcttccaattaagcaaagtacaatgctccaaataactaaggcaggttccactctgtgacgaaaactaaatatagccattcctaaataagcaaacacacaagtttctgcaataaaagccaaagttctcatcgtctgctgcatagttatttgtgtaaccgttgataaattgaaatgtgtgtaatgggacatcacaatgccacagaataatatcgccattatacctgataaatgaattccttctgccaaaacataaggtgcataagtaaacaccaacatcatacctaactctaaggacggatactttctaagatcaacatgtttcaacaaaagagcactaattaaggcaaagactacaccgataccagccgaagcaaagaacattaaacaaaacctatttaaaccggagactacagcttcagcagtcgtcattaaaggattgttggattccaaaactgcagttgttaaaacaattgaaatagcatcatttaaaatactttctccgaacaccaacatgtttaaaactgggtccacgtctaaagcatggaaaatagctacggtagctacagggtctactgcagaaattaatgaaccgaaagcaaaggattcaacaaagcttaagttataagcaacatctgccattcctagtaaatacacaccagcaccgacaacaaaggctgatatggctgttccaaatatagcaaacaccaggatggaaccaatattttgaaaaaaattacctttatgcaaattatacccggattcaaatattataggcggtagaagcactaagaaaaacgctgtgggtgaaaaggcttcttcattcttccaatttgcaatatttttagacgacattaaattaattatcaagccgattaaagcacctaagaaaactacaacaatactttcaggtaaatactgaaaccctgtttgtaacatgaaatgaattaaaagaatccctaaagccagcacacaaagcacgaagaatatagacatcgagctgtgttgttcttgttcagcggagcccttttcaggaagcactggatcaggattttcaatcgtggcattttgatcaggcggtagactggtttttgataaaagagtaatggaatctgttttggcagaagtgtttgtgtacaattcttccaaagaattgttggtaatagattcagttttggtataagatgcataatgtagcaggcatatcagaatgcagtataaatatatatttttaacgcccat

SEQ ID NO: 1872 - DNA, 2383 bp, Ctenocephalides felis
  CDS (60)..(845)
aattcttgtgtgtagaataaaaaacatatttgaaacgttcatataataaaaagtgcaacatgtcagatgaaatgcaagaaaacggaactattaatggtgaagtgccagaaattgaacttatcattaaggcatccaccatagatggtcgacgtaaaggagcttgtttattttgtcaagaatattttatggatttgtacctgctagcagaacttaaaactatcagtttaaaggttacaacagtagacatgcaaaaacctccaccggatttccgtacaaattttgaagcgacgccgccgccaattctaatcgacaatggcctggccgtgctagaaaacgacaaaatcgaacgtcacatcatgaagagtgtccctggaggacacaatctttttgttcaggataaagaagtggcaacactcatcgagaatttgtactctaaattgaagttggttttagtcaaaaaggatgacgtaaaaagcaatagtctgctgagccacctgaggaaaatcaacgaccatttggcgcggcgcggcacgagattcctaacgggcgacaccatgtgctgcttcgactgcgaactgatgcccaggttacaacacatcagggtcgccgccaagtatttcgtcgaatttgaaattccgagcaatctaaccgccttatggcgttatatgtatcacatgtaccagttggacgcattcacccagtcgtgcccagccgaccaagatatcatcaaccactataaactgcaacagcagaggatcagcaataaccagatgatgaaaatgaagaagcacgaggagctagaaacgccaacgttcaccacatcgattccagtcgacgtttcaggctgataggaaagaagtatttaaaacaaaattagtaatttggataatactaaacatgattatctgtatatgttaccgttccaaataaattattcatattaaaatacgattagtaagcgttatgatgtatccaaagttcgattaccatttttacaaatgccatcagttaggaatcttttctttgcttaatacaccaagagtttcattataattataacgtactataatatatttcgcaattgcaattggcatatcgttcaatattaatattacaaagctgccagtgatacgtcaatcatatttttgaacatattttatcttatgtttcagtaattctgtaagaatttttagatgcttatgtataaattggtgatatagcataaataacatatacgaatttgtatattttgaagtactatctgtgtaaactatccaaaactaacattcaaaatttgttttttgaaaaaaattatcttacaatatgtgtactataatataatgtatttagtattaaatgtttgagaaactaatttagttaagttgtatacaataaattataatcgtgttatattatgtttatatttacaaattttcgtgatggagtttaatgttagatgaatatattaaaatgtatgttctaacaattgtaatattaatgttaattttaaccgtaaattaaggaaaacattgttttgatgactacttagcttccgatccagaggtgatttagacatttagttagcattttaaaatattgtgtagctaacatttcgtgtgattttgacaactaatcagttatttaagaaatgtgcatataattattatatacatattattttacatacctgtttagtattcaaaaaacttgtcaattacttcgcacaaaagaacattgtgagtataataatatcatattatgcaaacattctttatttacgtgtagtttacttgaagtatcttggttttctttgctttttttcatttgattcagtaaaattaattcaaatctaacagtattttgcatagcagttatacgaaaattaaccagtgcttaacaatatttaaaatatttatataattcattaactagttatagtaaaaaaatatataaattcattttaaattaaaagacataatatattttacatattgtttaaatcttgtactttgccattttctctgtttgtttcatgtaatcttcggaagcgtagcaaatgttgtgtatattagtaatgtacagttgtataaaacataaattgtaagtccacttacaggcacatgctattgtcttattgaatttatttgttctaccaggaaagtgctttatagattttactaaatatatattaagaaaagcgttctctgttgaattgtaattaatccnttttgtaagatttacngcaagtatgaagaaatgttaaattttgttaaatttcatgtattgtatatgatattcgcacgtacttatgaaatgtatgncagtcaaatgctgaatttnttttaatanacnatctttgnantacctaaaaaaaaaaaaaaaa

SEQ ID NO: 1873 - protein, 262 aa, Ctenocephalides felis
MSDEMQENGTINGEVPEIELIIKASTIDGRRKGACLFCQEYFMDLYLLAELKTISLKVTTVDMQKPPPDFRTNFEATPPPILIDNGLAVLENDKIERHIMKSVPGGHNLFVQDKEVATLIENLYSKLKLVLVKKDDVKSNSLLSHLRKINDHLARRGTRFLTGDTMCCFDCELMPRLQHIRVAAKYFVEFEIPSNLTALWRYMYHMYQLDAFTQSCPADQDIINHYKLQQQRISNNQMMKMKKHEELETPTFTTSIPVDVSG

SEQ ID NO: 1874 - DNA, 2383 bp, Ctenocephalides felis
ttttttttttttttttaggtantncaaagatngtntattaaaanaaattcagcatttgactgncatacatttcataagtacgtgcgaatatcatatacaatacatgaaatttaacaaaatttaacatttcttcatacttgcngtaaatcttacaaaanggattaattacaattcaacagagaacgcttttcttaatatatatttagtaaaatctataaagcactttcctggtagaacaaataaattcaataagacaatagcatgtgcctgtaagtggacttacaatttatgttttatacaactgtacattactaatatacacaacatttgctacgcttccgaagattacatgaaacaaacagagaaaatggcaaagtacaagatttaaacaatatgtaaaatatattatgtcttttaatttaaaatgaatttatatatttttttactataactagttaatgaattatataaatattttaaatattgttaagcactggttaattttcgtataactgctatgcaaaatactgttagatttgaattaattttactgaatcaaatgaaaaaaagcaaagaaaaccaagatacttcaagtaaactacacgtaaataaagaatgtttgcataatatgatattattatactcacaatgttcttttgtgcgaagtaattgacaagttttttgaatactaaacaggtatgtaaaataatatgtatataataattatatgcacatttcttaaataactgattagttgtcaaaatcacacgaaatgttagctacacaatattttaaaatgctaactaaatgtctaaatcacctctggatcggaagctaagtagtcatcaaaacaatgttttccttaatttacggttaaaattaacattaatattacaattgttagaacatacattttaatatattcatctaacattaaactccatcacgaaaatttgtaaatataaacataatataacacgattataatttattgtatacaacttaactaaattagtttctcaaacatttaatactaaatacattatattatagtacacatattgtaagataatttttttcaaaaaacaaattttgaatgttagttttggatagtttacacagatagtacttcaaaatatacaaattcgtatatgttatttatgctatatcaccaatttatacataagcatctaaaaattcttacagaattactgaaacataagataaaatatgttcaaaaatatgattgacgtatcactggcagctttgtaatattaatattgaacgatatgccaattgcaattgcgaaatatattatagtacgttataattataatgaaactcttggtgtattaagcaaagaaaagattcctaactgatggcatttgtaaaaatggtaatcgaactttggatacatcataacgcttactaatcgtattttaatatgaataatttatttggaacggtaacatatacagataatcatgtttagtattatccaaattactaattttgttttaaatacttctttcctatcagcctgaaacgtcgactggaatcgatgtggtgaacgttggcgtttctagctcctcgtgcttcttcattttcatcatctggttattgctgatcctctgctgttgcagtttatagtggttgatgatatcttggtcggctgggcacgactgggtgaatgcgtccaactggtacatgtgatacatataacgccataaggcggttagattgctcggaatttcaaattcgacgaaatacttggcggcgaccctgatgtgttgtaacctgggcatcagttcgcagtcgaagcagcacatggtgtcgcccgttaggaatctcgtgccgcgccgcgccaaatggtcgttgattttcctcaggtggctcagcagactattgctttttacgtcatcctttttgactaaaaccaacttcaatttagagtacaaattctcgatgagtgttgccacttctttatcctgaacaaaaagattgtgtcctccagggacactcttcatgatgtgacgttcgattttgtcgttttctagcacggccaggccattgtcgattagaattggcggcggcgtcgcttcaaaatttgtacggaaatccggtggaggtttttgcatgtctactgttgtaacctttaaactgatagttttaagttctgctagcaggtacaaatccataaaatattcttgacaaaataaacaagctcctttacgtcgaccatctatggtggatgccttaatgataagttcaatttctggcacttcaccattaatagttccgttttcttgcatttcatctgacatgttgcactttttattatatgaacgtttcaaatatgttttttattctacacacaagaatt

SEQ ID NO: 1875 - DNA, 786 bp, Ctenocephalides felis
atgtcagatgaaatgcaagaaaacggaactattaatggtgaagtgccagaaattgaacttatcattaaggcatccaccatagatggtcgacgtaaaggagcttgtttattttgtcaagaatattttatggatttgtacctgctagcagaacttaaaactatcagtttaaaggttacaacagtagacatgcaaaaacctccaccggatttccgtacaaattttgaagcgacgccgccgccaattctaatcgacaatggcctggccgtgctagaaaacgacaaaatcgaacgtcacatcatgaagagtgtccctggaggacacaatctttttgttcaggataaagaagtggcaacactcatcgagaatttgtactctaaattgaagttggttttagtcaaaaaggatgacgtaaaaagcaatagtctgctgagccacctgaggaaaatcaacgaccatttggcgcggcgcggcacgagattcctaacgggcgacaccatgtgctgcttcgactgcgaactgatgcccaggttacaacacatcagggtcgccgccaagtatttcgtcgaatttgaaattccgagcaatctaaccgccttatggcgttatatgtatcacatgtaccagttggacgcattcacccagtcgtgcccagccgaccaagatatcatcaaccactataaactgcaacagcagaggatcagcaataaccagatgatgaaaatgaagaagcacgaggagctagaaacgccaacgttcaccacatcgattccagtcgacgtttcaggc

SEQ ID NO: 1876 - DNA, 786 bp, Ctenocephalides felis
gcctgaaacgtcgactggaatcgatgtggtgaacgttggcgtttctagctcctcgtgcttcttcattttcatcatctggttattgctgatcctctgctgttgcagtttatagtggttgatgatatcttggtcggctgggcacgactgggtgaatgcgtccaactggtacatgtgatacatataacgccataaggcggttagattgctcggaatttcaaattcgacgaaatacttggcggcgaccctgatgtgttgtaacctgggcatcagttcgcagtcgaagcagcacatggtgtcgcccgttaggaatctcgtgccgcgccgcgccaaatggtcgttgattttcctcaggtggctcagcagactattgctttttacgtcatcctttttgactaaaaccaacttcaatttagagtacaaattctcgatgagtgttgccacttctttatcctgaacaaaaagattgtgtcctccagggacactcttcatgatgtgacgttcgattttgtcgttttctagcacggccaggccattgtcgattagaattggcggcggcgtcgcttcaaaatttgtacggaaatccggtggaggtttttgcatgtctactgttgtaacctttaaactgatagttttaagttctgctagcaggtacaaatccataaaatattcttgacaaaataaacaagctcctttacgtcgaccatctatggtggatgccttaatgataagttcaatttctggcacttcaccattaatagttccgttttcttgcatttcatctgacat

SEQ ID NO: 1877 - DNA, 457 bp, Ctenocephalides felis
gcaaacaacaaggtccgctgatgcaagatccacacgattgtcacgcatattacacatgtctagaaattggatcattaccgaaacattttaattgtaataaaggtgcttatttcaatacagtcaaattaaaatgcgtgaaaggaaattgcgaaaatagcacagaaattcctcttcctgagcttccagacatttgcgatgaagtaggacctttggtgcaagatccaaacgattgccgcaagtattattcatgcgtcacgattggaaaagaacctgaacattttacgtgcaataaaggggcgtattttgatcgagaaagattacggtgtgtcagaggatcttgttaacaaatattgttatataacaaagttcaatctttaattattatttagaagaatttgaaaatgtatatttaatgttttttaataaaatagtttattggcaatttnaaaaaaaaaaa

SEQ ID NO: 1878 - DNA, 1291 bp, Ctenocephalides felis
gattagctgcccactatagggctaaagcggccgccgggtggtgttctgcagatccaagcccatgtttctcggaaggttctataacttgcaccggtccaggagtttttcctgatccgtatgattgtcagcgttatcatgaatgtaaaactgcaaatgaatcatctaagcctgtcgagtgtgggggttacaaggcttataatgttatagaaaataattgtagcctgaacatgaatcatcaatcgtgtaaacgcttacaatttcattgtgatactataggagatgaaaatgcttggccgagcaatagaaatatatattataggtgcaccgaaaaaaccttgtggttcaatagcaacaaaatattatatcctttattatatcggtgtgatgagagtgagatatatgatgcagtgcagagagtttgcgtaagagatgaaaccaccacgacgcctgccacaacgccaaccgaatcttccacgtctagtgaaacaaccacgacgtctgccacaacatcaaccgaatcttccacgtctagtgaaacaaccacgacgtctgccacaacaccaaccgaatcttccacgtctagtgaaacaaccacgacgtctgccacaacaccaaccgaatcttccacgtctagtgaaacaaccacgacgtctgccacaacaccaaccgaatcttccacgtctagtgaaacaaccacgacgtctgccacaacaccaaccgaatcttccacgtctggtgaaacaaccacgacgtctgccacaacaccaaccgaaccttccacaaagcctacttctacggaaactcccgcaacaaaaccaccgcaagaaataccatgcaaacaacaaggtccgctgatgcaagatccacacgattgtcacgcatattacacatgtctagaaattggatcattaccgaaacattttaattgtaataaaggtgcttatttcaatacagtcaaattaaaatgcgtgaaaggaaattgcgaaaatagcacagaaattcctcttcctgagcttccagacatttgcgatgaagtaggacctttggtgcaagatccaaacgattgccgcaagtattattcatgcgtcacgattggaaaagaacctgaacattttacgtgcaataaaggggcgtattttgatcgagaaagattacggtgtgtcagaggatcttgttaacaaatattgttatataacaaagttcaatctttaattattatttagaagaatttgaaaatgtatatttaatgttttttaataaaatagtttattggcaatttnaaaaaaaaaaa

SEQ ID NO: 1879 - DNA, 1291 bp, Ctenocephalides felis
tttttttttttnaaattgccaataaactattttattaaaaaacattaaatatacattttcaaattcttctaaataataattaaagattgaactttgttatataacaatatttgttaacaagatcctctgacacaccgtaatctttctcgatcaaaatacgcccctttattgcacgtaaaatgttcaggttcttttccaatcgtgacgcatgaataatacttgcggcaatcgtttggatcttgcaccaaaggtcctacttcatcgcaaatgtctggaagctcaggaagaggaatttctgtgctattttcgcaatttcctttcacgcattttaatttgactgtattgaaataagcacctttattacaattaaaatgtttcggtaatgatccaatttctagacatgtgtaatatgcgtgacaatcgtgtggatcttgcatcagcggaccttgttgtttgcatggtatttcttgcggtggttttgttgcgggagtttccgtagaagtaggctttgtggaaggttcggttggtgttgtggcagacgtcgtggttgtttcaccagacgtggaagattcggttggtgttgtggcagacgtcgtggttgtttcactagacgtggaagattcggttggtgttgtggcagacgtcgtggttgtttcactagacgtggaagattcggttggtgttgtggcagacgtcgtggttgtttcactagacgtggaagattcggttggtgttgtggcagacgtcgtggttgtttcactagacgtggaagattcggttgatgttgtggcagacgtcgtggttgtttcactagacgtggaagattcggttggcgttgtggcaggcgtcgtggtggtttcatctcttacgcaaactctctgcactgcatcatatatctcactctcatcacaccgatataataaaggatataatattttgttgctattgaaccacaaggttttttcggtgcacctataatatatatttctattgctcggccaagcattttcatctcctatagtatcacaatgaaattgtaagcgtttacacgattgatgattcatgttcaggctacaattattttctataacattataagccttgtaacccccacactcgacaggcttagatgattcatttgcagttttacattcatgataacgctgacaatcatacggatcaggaaaaactcctggaccggtgcaagttatagaaccttccgagaaacatgggcttggatctgcagaacaccacccggcggccgctttagccctatagtgggcagctaatc

SEQ ID NO: 1880 - DNA, 279 bp, Ctenocephalides felis
caatgatcaagtcagttataattgtggccaacttttggctattcgtagccttgcaatcgattgataatcggcagactaacaactgctctgagattggtgttgatggttttttttgtctcaactgcagcgtcacagctttttgtggtagaggacctacgggtgaattcaacaccgtgtctacaagtccatgtagttctggtgaagtttgcagtacctgggcgggtagatgttctgcagatccaagcccatgtttctcggaaggttctataacttgcaccg

SEQ ID NO: 1881 - DNA, 279 bp, Ctenocephalides felis
cggtgcaagttatagaaccttccgagaaacatgggcttggatctgcagaacatctacccgcccaggtactgcaaacttcaccagaactacatggacttgtagacacggtgttgaattcacccgtaggtcctctaccacaaaaagctgtgacgctgcagttgagacaaaaaaaaccatcaacaccaatctcagagcagttgttagtctgccgattatcaatcgattgcaaggctacgaatagccaaaagttggccacaattataactgacttgatcattg

SEQ ID NO: 1882 - DNA, 1477 bp, Ctenocephalides felis
  CDS (3)..(1361)
caatgatcaagtcagttataattgtggccaacttttggctattcgtagccttgcaatcgattgataatcggcagactaacaactgctctgagattggtgttgatggttttttttgtctcaactgcagcgtcacagctttttgtggtagaggacctacgggtgaattcaacaccgtgtctacaagtccatgtagttctggtgaagtttgcagtacctgggcgggtagatgttctgcagatccaagcccatgtttctcggaaggttctataacttgcaccggtccaggagtttttcctgatccgtatgattgtcagcgttatcatgaatgtaaaactgcaaatgaatcatctaagcctgtcgagtgtgggggttacaaggcttataatgttatagaaaataattgtagcctgaacatgaatcatcaatcgtgtaaacgcttacaatttcattgtgatactataggagatgaaaatgcttggccgagcaatagaaatatatattataggtgcaccgaaaaaaccttgtggttcaatagcaacaaaatattatatcctttattatatcggtgtgatgagagtgagatatatgatgcagtgcagagagtttgcgtaagagatgaaaccaccacgacgcctgccacaacgccaaccgaatcttccacgtctagtgaaacaaccacgacgtctgccacaacatcaaccgaatcttccacgtctagtgaaacaaccacgacgtctgccacaacaccaaccgaatcttccacgtctagtgaaacaaccacgacgtctgccacaacaccaaccgaatcttccacgtctagtgaaacaaccacgacgtctgccacaacaccaaccgaatcttccacgtctagtgaaacaaccacgacgtctgccacaacaccaaccgaatcttccacgtctggtgaaacaaccacgacgtctgccacaacaccaaccgaaccttccacaaagcctacttctacggaaactcccgcaacaaaaccaccgcaagaaataccatgcaaacaacaaggtccgctgatgcaagatccacacgattgtcacgcatattacacatgtctagaaattggatcattaccgaaacattttaattgtaataaaggtgcttatttcaatacagtcaaattaaaatgcgtgaaaggaaattgcgaaaatagcacagaaattcctcttcctgagcttccagacatttgcgatgaagtaggacctttggtgcaagatccaaacgattgccgcaagtattattcatgcgtcacgattggaaaagaacctgaacattttacgtgcaataaaggggcgtattttgatcgagaaagattacggtgtgtcagaggatcttgttaacaaatattgttatataacaaagttcaatctttaattattatttagaagaatttgaaaatgtatatttaatgttttttaataaaatagtttattggcaatttnaaaaaaaaaaa

SEQ ID NO: 1883 - protein, 453 aa, Ctenocephalides felis
MIKSVIIVANFWLFVALQSIDNRQTNNCSEIGVDGFFCLNCSVTAFCGRGPTGEFNTVSTSPCSSGEVCSTWAGRCSADPSPCFSEGSITCTGPGVFPDPYDCQRYHECKTANESSKPVECGGYKAYNVIENNCSLNMNHQSCKRLQFHCDTIGDENAWPSNRNIYYRCTEKTLWFNSNKILYPLLYRCDESEIYDAVQRVCVRDETTTTPATTPTESSTSSETTTTSATTSTESSTSSETTTTSATTPTESSTSSETTTTSATTPTESSTSSETTTTSATTPTESSTSSETTTTSATTPTESSTSGETTTTSATTPTEPSTKPTSTETPATKPPQEIPCKQQGPLMQDPHDCHAYYTCLEIGSLPKHFNCNKGAYFNTVKLKCVKGNCENSTEIPLPELPDICDEVGPLVQDPNDCRKYYSCVTIGKEPEHFTCNKGAYFDRERLRCVRGSC

SEQ ID NO: 1884 - DNA, 1477 bp, Ctenocephalides felis
tttttttttttnaaattgccaataaactattttattaaaaaacattaaatatacattttcaaattcttctaaataataattaaagattgaactttgttatataacaatatttgttaacaagatcctctgacacaccgtaatctttctcgatcaaaatacgcccctttattgcacgtaaaatgttcaggttcttttccaatcgtgacgcatgaataatacttgcggcaatcgtttggatcttgcaccaaaggtcctacttcatcgcaaatgtctggaagctcaggaagaggaatttctgtgctattttcgcaatttcctttcacgcattttaatttgactgtattgaaataagcacctttattacaattaaaatgtttcggtaatgatccaatttctagacatgtgtaatatgcgtgacaatcgtgtggatcttgcatcagcggaccttgttgtttgcatggtatttcttgcggtggttttgttgcgggagtttccgtagaagtaggctttgtggaaggttcggttggtgttgtggcagacgtcgtggttgtttcaccagacgtggaagattcggttggtgttgtggcagacgtcgtggttgtttcactagacgtggaagattcggttggtgttgtggcagacgtcgtggttgtttcactagacgtggaagattcggttggtgttgtggcagacgtcgtggttgtttcactagacgtggaagattcggttggtgttgtggcagacgtcgtggttgtttcactagacgtggaagattcggttgatgttgtggcagacgtcgtggttgtttcactagacgtggaagattcggttggcgttgtggcaggcgtcgtggtggtttcatctcttacgcaaactctctgcactgcatcatatatctcactctcatcacaccgatataataaaggatataatattttgttgctattgaaccacaaggttttttcggtgcacctataatatatatttctattgctcggccaagcattttcatctcctatagtatcacaatgaaattgtaagcgtttacacgattgatgattcatgttcaggctacaattattttctataacattataagccttgtaacccccacactcgacaggcttagatgattcatttgcagttttacattcatgataacgctgacaatcatacggatcaggaaaaactcctggaccggtgcaagttatagaaccttccgagaaacatgggcttggatctgcagaacatctacccgcccaggtactgcaaacttcaccagaactacatggacttgtagacacggtgttgaattcacccgtaggtcctctaccacaaaaagctgtgacgctgcagttgagacaaaaaaaaccatcaacaccaatctcagagcagttgttagtctgccgattatcaatcgattgcaaggctacgaatagccaaaagttggccacaattataactgacttgatcattg

SEQ ID NO: 1885 - DNA, 1359 bp, Ctenocephalides felis
atgatcaagtcagttataattgtggccaacttttggctattcgtagccttgcaatcgattgataatcggcagactaacaactgctctgagattggtgttgatggttttttttgtctcaactgcagcgtcacagctttttgtggtagaggacctacgggtgaattcaacaccgtgtctacaagtccatgtagttctggtgaagtttgcagtacctgggcgggtagatgttctgcagatccaagcccatgtttctcggaaggttctataacttgcaccggtccaggagtttttcctgatccgtatgattgtcagcgttatcatgaatgtaaaactgcaaatgaatcatctaagcctgtcgagtgtgggggttacaaggcttataatgttatagaaaataattgtagcctgaacatgaatcatcaatcgtgtaaacgcttacaatttcattgtgatactataggagatgaaaatgcttggccgagcaatagaaatatatattataggtgcaccgaaaaaaccttgtggttcaatagcaacaaaatattatatcctttattatatcggtgtgatgagagtgagatatatgatgcagtgcagagagtttgcgtaagagatgaaaccaccacgacgcctgccacaacgccaaccgaatcttccacgtctagtgaaacaaccacgacgtctgccacaacatcaaccgaatcttccacgtctagtgaaacaaccacgacgtctgccacaacaccaaccgaatcttccacgtctagtgaaacaaccacgacgtctgccacaacaccaaccgaatcttccacgtctagtgaaacaaccacgacgtctgccacaacaccaaccgaatcttccacgtctagtgaaacaaccacgacgtctgccacaacaccaaccgaatcttccacgtctggtgaaacaaccacgacgtctgccacaacaccaaccgaaccttccacaaagcctacttctacggaaactcccgcaacaaaaccaccgcaagaaataccatgcaaacaacaaggtccgctgatgcaagatccacacgattgtcacgcatattacacatgtctagaaattggatcattaccgaaacattttaattgtaataaaggtgcttatttcaatacagtcaaattaaaatgcgtgaaaggaaattgcgaaaatagcacagaaattcctcttcctgagcttccagacatttgcgatgaagtaggacctttggtgcaagatccaaacgattgccgcaagtattattcatgcgtcacgattggaaaagaacctgaacattttacgtgcaataaaggggcgtattttgatcgagaaagattacggtgtgtcagaggatcttgt

SEQ ID NO: 1886 - DNA, 1359 bp, Ctenocephalides felis
acaagatcctctgacacaccgtaatctttctcgatcaaaatacgcccctttattgcacgtaaaatgttcaggttcttttccaatcgtgacgcatgaataatacttgcggcaatcgtttggatcttgcaccaaaggtcctacttcatcgcaaatgtctggaagctcaggaagaggaatttctgtgctattttcgcaatttcctttcacgcattttaatttgactgtattgaaataagcacctttattacaattaaaatgtttcggtaatgatccaatttctagacatgtgtaatatgcgtgacaatcgtgtggatcttgcatcagcggaccttgttgtttgcatggtatttcttgcggtggttttgttgcgggagtttccgtagaagtaggctttgtggaaggttcggttggtgttgtggcagacgtcgtggttgtttcaccagacgtggaagattcggttggtgttgtggcagacgtcgtggttgtttcactagacgtggaagattcggttggtgttgtggcagacgtcgtggttgtttcactagacgtggaagattcggttggtgttgtggcagacgtcgtggttgtttcactagacgtggaagattcggttggtgttgtggcagacgtcgtggttgtttcactagacgtggaagattcggttgatgttgtggcagacgtcgtggttgtttcactagacgtggaagattcggttggcgttgtggcaggcgtcgtggtggtttcatctcttacgcaaactctctgcactgcatcatatatctcactctcatcacaccgatataataaaggatataatattttgttgctattgaaccacaaggttttttcggtgcacctataatatatatttctattgctcggccaagcattttcatctcctatagtatcacaatgaaattgtaagcgtttacacgattgatgattcatgttcaggctacaattattttctataacattataagccttgtaacccccacactcgacaggcttagatgattcatttgcagttttacattcatgataacgctgacaatcatacggatcaggaaaaactcctggaccggtgcaagttatagaaccttccgagaaacatgggcttggatctgcagaacatctacccgcccaggtactgcaaacttcaccagaactacatggacttgtagacacggtgttgaattcacccgtaggtcctctaccacaaaaagctgtgacgctgcagttgagacaaaaaaaaccatcaacaccaatctcagagcagttgttagtctgccgattatcaatcgattgcaaggctacgaatagccaaaagttggccacaattataactgacttgatcat

SEQ ID NO: 1887 - DNA, 406 bp, Ctenocephalides felis; identical to SEQ ID NO: 1419
  CDS (20)..(262)

SEQ ID NO: 1888 - protein, 81 aa, Ctenocephalides felis
MKGTLLILSCLVIMISAEYADVDVCQDLDDGTFLADSNNCQNFFICDGGRAWKMYCPGSLLWNDHEGTCDYAQNVECYQPE

SEQ ID NO: 1889 - DNA, 406 bp, Ctenocephalides felis
tttttttttttttttttttgtctttatattgattttattaaaacggaataaatttataggaggagagcaatgaagataaatttattataacagtagtatgaaatatagtttcagaaaatcgctgtcagatattaaaatgttttattctggttggtaacattctacattttgtgcgtaatcacatgttccttcgtgatcattccataaaagtgatcctggacaatacattttccaagctcggcctccatcacaaatgaagaaattttggcaattgtttgaatcagcaagaaaagttccatcgtccaaatcttggcacacatctacgtcagcatattcggcacttatcatgatcacaagacatgataatattaataatgttcctttcattttgttattttaaattaac

SEQ ID NO: 1890 - DNA, 243 bp, Ctenocephalides felis
atgaaaggaacattattaatattatcatgtcttgtgatcatgataagtgccgaatatgctgacgtagatgtgtgccaagatttggacgatggaacttttcttgctgattcaaacaattgccaaaatttcttcatttgtgatggaggccgagcttggaaaatgtattgtccaggatcacttttatggaatgatcacgaaggaacatgtgattacgcacaaaatgtagaatgttaccaaccagaa

SEQ ID NO: 1891 - DNA, 243 bp, Ctenocephalides felis
ttctggttggtaacattctacattttgtgcgtaatcacatgttccttcgtgatcattccataaaagtgatcctggacaatacattttccaagctcggcctccatcacaaatgaagaaattttggcaattgtttgaatcagcaagaaaagttccatcgtccaaatcttggcacacatctacgtcagcatattcggcacttatcatgatcacaagacatgataatattaataatgttcctttcat

SEQ ID NO: 1892 - DNA, 974 bp, Ctenocephalides felis
ttaatgtcgacggaacgcctttaacagtaaataaagaagtatttgcatcattggatgagcccgcaccaggagtagtacctactcctgaacctacacctgtaccgaaacccgagcaaaaatgtaaaaaagtaaaatttagttgcgtgaattcgtgcagttcacccgaaatgcagtattgtccggaaataggagcagatccggttaaggaatcctgtagcccagatcaagtgtgcgctgatcaaagtggatatctacagtgcaccactaaagaaagtacagtctgcaaagtacaaggtttcaaatgtccgtcaccatcgagattttatccaaatataaatgattgtcaaagctattattattgtgacgaaaatagtataggaacccaatattattgccccgcaaattttgcatatgatccgttacgtcataattgcggacctatggctctgggcacaaaatgctatacagttacatgtcctgcacagcctaaggtgcttccgtacattggtgataaatcattgtacgtcgtatgtatggccggaagaggaaccgtattgcaatgcgaagaacccgccgagttttccccaaggagcgaaacctgtgtcgggcaatgccgagcacgtggaaaatttgctttcaagaacgacgcaacatgccggaagttcttcacgtgtttacgtcctaaaggagagccagttcctgatcaatgtccgattggaacagtatttaaccaagctactcaaagctgcaacacaggaacttgcgagaggaaacctaaattatattaatatattgatgaagtattcaacaaaagaaactatacaaaatatgtactttgttttactttatgtgttatataaaaaaatattatggttgaacacaggctcgcaaatatgataaggcatttaagaattttacaatttagatttttttaaatccatgaatatatttgttctaatcaaaaaaaaaaaaaa

SEQ ID NO: 1893 - DNA, 974 bp, Ctenocephalides felis; identical to SEQ ID NO: 1892

SEQ ID NO: 1894 - DNA, 1043 bp, Ctenocephalides felis
tgttttatatcacattggtttttattagttttgtggcgttatctgtcgttaccgcttatgatggtgagtttaatgtcgacggaacgcctttaacagtaaataaagaagtatttgcatcattggatgagcccgcaccaggagtagtacctactcctgaacctacacctgtaccgaaacccgagcaaaaatgtaaaaaagtaaaatttagttgcgtgaattcgtgcagttcacccgaaatgcagtattgtccggaaataggagcagatccggttaaggaatcctgtagcccagatcaagtgtgcgctgatcaaagtggatatctacagtgcaccactaaagaaagtacagtctgcaaagtacaaggtttcaaatgtccgtcaccatcgagattttatccaaatataaatgattgtcaaagctattattattgtgacgaaaatagtataggaacccaatattattgccccgcaaattttgcatatgatccgttacgtcataattgcggacctatggctctgggcacaaaatgctatacagttacatgtcctgcacagcctaaggtgcttccgtacattggtgataaatcattgtacgtcgtatgtatggccggaagaggaaccgtattgcaatgcgaagaacccgccgagttttccccaaggagcgaaacctgtgtcgggcaatgccgagcacgtggaaaatttgctttcaagaacgacgcaacatgccggaagttcttcacgtgtttacgtcctaaaggagagccagttcctgatcaatgtccgattggaacagtatttaaccaagctactcaaagctgcaacacaggaacttgcgagaggaaacctaaattatattaatatattgatgaagtattcaacaaaagaaactatacaaaatatgtactttgttttactttatgtgttatataaaaaaatattatggttgaacacaggctcgcaaatatgataaggcatttaagaattttacaatttagatttttttaaatccatgaatatatttgttctaatcaaaaaaaaaaaaaa

SEQ ID NO: 1895 - DNA, 1043 bp, Ctenocephalides felis
ttttttttttttttgattagaacaaatatattcatggatttaaaaaaatctaaattgtaaaattcttaaatgccttatcatatttgcgagcctgtgttcaaccataatatttttttatataacacataaagtaaaacaaagtacatattttgtatagtttcttttgttgaatacttcatcaatatattaatataatttaggtttcctctcgcaagttcctgtgttgcagctttgagtagcttggttaaatactgttccaatcggacattgatcaggaactggctctcctttaggacgtaaacacgtgaagaacttccggcatgttgcgtcgttcttgaaagcaaattttccacgtgctcggcattgcccgacacaggtttcgctccttggggaaaactcggcgggttcttcgcattgcaatacggttcctcttccggccatacatacgacgtacaatgatttatcaccaatgtacggaagcaccttaggctgtgcaggacatgtaactgtatagcattttgtgcccagagccataggtccgcaattatgacgtaacggatcatatgcaaaatttgcggggcaataatattgggttcctatactattttcgtcacaataataatagctttgacaatcatttatatttggataaaatctcgatggtgacggacatttgaaaccttgtactttgcagactgtactttctttagtggtgcactgtagatatccactttgatcagcgcacacttgatctgggctacaggattccttaaccggatctgctcctatttccggacaatactgcatttcgggtgaactgcacgaattcacgcaactaaattttacttttttacatttttgctcgggtttcggtacaggtgtaggttcaggagtaggtactactcctggtgcgggctcatccaatgatgcaaatacttctttatttactgttaaaggcgttccgtcgacattaaactcaccatcataagcggtaacgacagataacgccacaaaactaataaaaaccaatgtgatataaaaca

SEQ ID NO: 1896 - DNA, 1062 bp, Ctenocephalides felis
  CDS (19)..(873)
gtaacatatttattaagaatgttttatatcacattggtttttattagttttgtggcgttatctgtcgttaccgcttatgatggtgagtttaatgtcgacggaacgcctttaacagtaaataaagaagtatttgcatcattggatgagcccgcaccaggagtagtacctactcctgaacctacacctgtaccgaaacccgagcaaaaatgtaaaaaagtaaaatttagttgcgtgaattcgtgcagttcacccgaaatgcagtattgtccggaaataggagcagatccggttaaggaatcctgtagcccagatcaagtgtgcgctgatcaaagtggatatctacagtgcaccactaaagaaagtacagtctgcaaagtacaaggtttcaaatgtccgtcaccatcgagattttatccaaatataaatgattgtcaaagctattattattgtgacgaaaatagtataggaacccaatattattgccccgcaaattttgcatatgatccgttacgtcataattgcggacctatggctctgggcacaaaatgctatacagttacatgtcctgcacagcctaaggtgcttccgtacattggtgataaatcattgtacgtcgtatgtatggccggaagaggaaccgtattgcaatgcgaagaacccgccgagttttccccaaggagcgaaacctgtgtcgggcaatgccgagcacgtggaaaatttgctttcaagaacgacgcaacatgccggaagttcttcacgtgtttacgtcctaaaggagagccagttcctgatcaatgtccgattggaacagtatttaaccaagctactcaaagctgcaacacaggaacttgcgagaggaaacctaaattatattaatatattgatgaagtattcaacaaaagaaactatacaaaatatgtactttgttttactttatgtgttatataaaaaaatattatggttgaacacaggctcgcaaatatgataaggcatttaagaattttacaatttagatttttttaaatccatgaatatatttgttctaatcaaaaaaaaaaaaaa

SEQ ID NO: 1897 - protein, 285 aa, Ctenocephalides felis
MFYITLVFISFVALSVVTAYDGEFNVDGTPLTVNKEVFASLDEPAPGVVPTPEPTPVPKPEQKCKKVKFSCVNSCSSPEMQYCPEIGADPVKESCSPDQVCADQSGYLQCTTKESTVCKVQGFKCPSPSRFYPNINDCQSYYYCDENSIGTQYYCPANFAYDPLRHNCGPMALGTKCYTVTCPAQPKVLPYIGDKSLYVVCMAGRGTVLQCEEPAEFSPRSETCVGQCRARGKFAFKNDATCRKFFTCLRPKGEPVPDQCPIGTVFNQATQSCNTGTCERKPKLY

SEQ ID NO: 1898 - DNA, 1062 bp, Ctenocephalides felis; identical to SEQ ID NO: 1896

SEQ ID NO: 1899 - DNA, 855 bp, Ctenocephalides felis
atgttttatatcacattggtttttattagttttgtggcgttatctgtcgttaccgcttatgatggtgagtttaatgtcgacggaacgcctttaacagtaaataaagaagtatttgcatcattggatgagcccgcaccaggagtagtacctactcctgaacctacacctgtaccgaaacccgagcaaaaatgtaaaaaagtaaaatttagttgcgtgaattcgtgcagttcacccgaaatgcagtattgtccggaaataggagcagatccggttaaggaatcctgtagcccagatcaagtgtgcgctgatcaaagtggatatctacagtgcaccactaaagaaagtacagtctgcaaagtacaaggtttcaaatgtccgtcaccatcgagattttatccaaatataaatgattgtcaaagctattattattgtgacgaaaatagtataggaacccaatattattgccccgcaaattttgcatatgatccgttacgtcataattgcggacctatggctctgggcacaaaatgctatacagttacatgtcctgcacagcctaaggtgcttccgtacattggtgataaatcattgtacgtcgtatgtatggccggaagaggaaccgtattgcaatgcgaagaacccgccgagttttccccaaggagcgaaacctgtgtcgggcaatgccgagcacgtggaaaatttgctttcaagaacgacgcaacatgccggaagttcttcacgtgtttacgtcctaaaggagagccagttcctgatcaatgtccgattggaacagtatttaaccaagctactcaaagctgcaacacaggaacttgcgagaggaaacctaaattatat

SEQ ID NO: 1900 - DNA, 855 bp, Ctenocephalides felis
atataatttaggtttcctctcgcaagttcctgtgttgcagctttgagtagcttggttaaatactgttccaatcggacattgatcaggaactggctctcctttaggacgtaaacacgtgaagaacttccggcatgttgcgtcgttcttgaaagcaaattttccacgtgctcggcattgcccgacacaggtttcgctccttggggaaaactcggcgggttcttcgcattgcaatacggttcctcttccggccatacatacgacgtacaatgatttatcaccaatgtacggaagcaccttaggctgtgcaggacatgtaactgtatagcattttgtgcccagagccataggtccgcaattatgacgtaacggatcatatgcaaaatttgcggggcaataatattgggttcctatactattttcgtcacaataataatagctttgacaatcatttatatttggataaaatctcgatggtgacggacatttgaaaccttgtactttgcagactgtactttctttagtggtgcactgtagatatccactttgatcagcgcacacttgatctgggctacaggattccttaaccggatctgctcctatttccggacaatactgcatttcgggtgaactgcacgaattcacgcaactaaattttacttttttacatttttgctcgggtttcggtacaggtgtaggttcaggagtaggtactactcctggtgcgggctcatccaatgatgcaaatacttctttatttactgttaaaggcgttccgtcgacattaaactcaccatcataagcggtaacgacagataacgccacaaaactaataaaaaccaatgtgatataaaacat

SEQ ID NO: 1901 - DNA, 1875 bp, Ctenocephalides felis
  CDS (44)..(1633)
acaaaacggtttaattgaatctgtagtttggaaattaataaatatggacagtaacacggggattcaaataatagcttccaaagaaccaaaaccaaggcagtttgaagatgcgttggcactcacaggttttggaaaattcaattaccttcttctggtcgtgagtggatgcgtattagtatgtgttttgatggaaactcttggaatgagttttgtcgttccttcagcacaatgtgatctggaattaacaacaaaacaaaaaggaatattaagcgctatagcttttataggtattataagcagttcacatttatggggatttttagccgatacgagagggaggcggaaagtgattatgcctacacttcttcttgcatttttttgtaccttggcatctagttttgtaaattcagtttggctgtttattttgctgcgatatttcaatggatttttcgtatctggaggaagtgcaacaatatatgcatatttaggagaatttcataatcctaggcatcgcagcagggctattatgggagcgtcaagcatcttcggatttgcgtgtcttgcattaccgacggttgcatggttaattataaatcagaaatggtcattctatattgactttttgggatatacatacaagccctggaggttgtatatggttgcatgtggtttgccatcactgctttgttgttttgctttgtggaaattaccagaaagtcccaaatttttgatgaatcagggaagaaacgaagaagctcgtcaaattattgccaaaatgtatagaattaatactggtaaaccagaaagtgaattccccgtatcatcaatcttagatgaatatccaggagtggatggtgaaaatacaaataaaacaaagaaatcatttttaagaactgtatgggatcaaactgctccgctgtttatgggtgagcacatgaaaaaaacactcattgcatgtactctgcaattcggaatatttgccacatctaacggcatgtacatgtggtttcccgatatcataagtaaaatgacagaatttcaaaacgctcatccaggagtaccaagtacaatatgctacgttgtccaaaattcatcaatgcttagggcggacgacttcattgatactacgaatagtacgaccgagtgtaaagacacaatggaagaacaggcatttatgcattctttaatgttggaagctggatatgcgattggatttcccataataggtgctattattaactctgtgggaaagcttccaattcttgtattcgtgatggtctcatgcgggatttgtggaataatttgtgcatttattgaacatttaacaatagcatcatatttatatttgtggttgctggtttgcggaattgctgtgacagtggtaaacgcggcattagtagatctgtaccctacacaactcagggcaatggcagtatgtatatctttaatgatgggtcgattaggaagtgttgttggaagcaatgttgtaggaataattctagattataattgcgatttaacatttttaatatcaggaacatctctgatagcatgtggagtgattgcattctttataccgaacatttatcagaagcaagtggatagaagaacgagcattgcttcatatggaccataaccatatttccgtcgtgtgttgtgaaatgcaattatactttgagaaagtattatcaattacaaagaaaattcagagttgctactgaatcattttctaaaacatcgacatgaaaattaataactctttattgttattagattcgatgtaagatatatgtacatactcataggtaaaaaatgttaatgccgtcaatgttcaaaattataaagagaataaataaatacgttaaaaaaaaaaaa

SEQ ID NO: 1902 - protein, 530 aa, Ctenocephalides felis
MDSNTGIQIIASKEPKPRQFEDALALTGFGKFNYLLLVVSGCVLVCVLMETLGMSFVVPSAQCDLELTTKQKGILSAIAFIGIISSSHLWGFLADTRGRRKVIMPTLLLAFFCTLASSFVNSVWLFILLRYFNGFFVSGGSATIYAYLGEFHNPRHRSRAIMGASSIFGFACLALPTVAWLIINQKWSFYIDFLGYTYKPWRLYMVACGLPSLLCCFALWKLPESPKFLMNQGRNEEARQIIAKMYRINTGKPESEFPVSSILDEYPGVDGENTNKTKKSFLRTVWDQTAPLFMGEHMKKTLIACTLQFGIFATSNGMYMWFPDIISKMTEFQNAHPGVPSTICYVVQNSSMLRADDFIDTTNSTTECKDTMEEQAFMHSLMLEAGYAIGFPIIGAIINSVGKLPILVFVMVSCGICGIICAFIEHLTIASYLYLWLLVCGIAVTVVNAALVDLYPTQLRAMAVCISLMMGRLGSVVGSNVVGIILDYNCDLTFLISGTSLIACGVIAFFIPNIYQKQVDRRTSIASYGP

SEQ ID NO: 1903 - DNA, 1875 bp, Ctenocephalides felis
ttttttttttttaacgtatttatttattctctttataattttgaacattgacggcattaacattttttacctatgagtatgtacatatatcttacatcgaatctaataacaataaagagttattaattttcatgtcgatgttttagaaaatgattcagtagcaactctgaattttctttgtaattgataatactttctcaaagtataattgcatttcacaacacacgacggaaatatggttatggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgccattgccctgagttgtgtagggtacagatctactaatgccgcgtttaccactgtcacagcaattccgcaaaccagcaaccacaaatataaatatgatgctattgttaaatgttcaataaatgcacaaattattccacaaatcccgcatgagaccatcacgaatacaagaattggaagctttcccacagagttaataatagcacctattatgggaaatccaatcgcatatccagcttccaacattaaagaatgcataaatgcctgttcttccattgtgtctttacactcggtcgtactattcgtagtatcaatgaagtcgtccgccctaagcattgatgaattttggacaacgtagcatattgtacttggtactcctggatgagcgttttgaaattctgtcattttacttatgatatcgggaaaccacatgtacatgccgttagatgtggcaaatattccgaattgcagagtacatgcaatgagtgtttttttcatgtgctcacccataaacagcggagcagtttgatcccatacagttcttaaaaatgatttctttgttttatttgtattttcaccatccactcctggatattcatctaagattgatgatacggggaattcactttctggtttaccagtattaattctatacattttggcaataatttgacgagcttcttcgtttcttccctgattcatcaaaaatttgggactttctggtaatttccacaaagcaaaacaacaaagcagtgatggcaaaccacatgcaaccatatacaacctccagggcttgtatgtatatcccaaaaagtcaatatagaatgaccatttctgatttataattaaccatgcaaccgtcggtaatgcaagacacgcaaatccgaagatgcttgacgctcccataatagccctgctgcgatgcctaggattatgaaattctcctaaatatgcatatattgttgcacttcctccagatacgaaaaatccattgaaatatcgcagcaaaataaacagccaaactgaatttacaaaactagatgccaaggtacaaaaaaatgcaagaagaagtgtaggcataatcactttccgcctccctctcgtatcggctaaaaatccccataaatgtgaactgcttataatacctataaaagctatagcgcttaatattcctttttgttttgttgttaattccagatcacattgtgctgaaggaacgacaaaactcattccaagagtttccatcaaaacacatactaatacgcatccactcacgaccagaagaaggtaattgaattttccaaaacctgtgagtgccaacgcatcttcaaactgccttggttttggttctttggaagctattatttgaatccccgtgttactgtccatatttattaatttccaaactacagattcaattaaaccgttttgt

SEQ ID NO: 1904 - DNA, 1590 bp, Ctenocephalides felis
atggacagtaacacggggattcaaataatagcttccaaagaaccaaaaccaaggcagtttgaagatgcgttggcactcacaggttttggaaaattcaattaccttcttctggtcgtgagtggatgcgtattagtatgtgttttgatggaaactcttggaatgagttttgtcgttccttcagcacaatgtgatctggaattaacaacaaaacaaaaaggaatattaagcgctatagcttttataggtattataagcagttcacatttatggggatttttagccgatacgagagggaggcggaaagtgattatgcctacacttcttcttgcatttttttgtaccttggcatctagttttgtaaattcagtttggctgtttattttgctgcgatatttcaatggatttttcgtatctggaggaagtgcaacaatatatgcatatttaggagaatttcataatcctaggcatcgcagcagggctattatgggagcgtcaagcatcttcggatttgcgtgtcttgcattaccgacggttgcatggttaattataaatcagaaatggtcattctatattgactttttgggatatacatacaagccctggaggttgtatatggttgcatgtggtttgccatcactgctttgttgttttgctttgtggaaattaccagaaagtcccaaatttttgatgaatcagggaagaaacgaagaagctcgtcaaattattgccaaaatgtatagaattaatactggtaaaccagaaagtgaattccccgtatcatcaatcttagatgaatatccaggagtggatggtgaaaatacaaataaaacaaagaaatcatttttaagaactgtatgggatcaaactgctccgctgtttatgggtgagcacatgaaaaaaacactcattgcatgtactctgcaattcggaatatttgccacatctaacggcatgtacatgtggtttcccgatatcataagtaaaatgacagaatttcaaaacgctcatccaggagtaccaagtacaatatgctacgttgtccaaaattcatcaatgcttagggcggacgacttcattgatactacgaatagtacgaccgagtgtaaagacacaatggaagaacaggcatttatgcattctttaatgttggaagctggatatgcgattggatttcccataataggtgctattattaactctgtgggaaagcttccaattcttgtattcgtgatggtctcatgcgggatttgtggaataatttgtgcatttattgaacatttaacaatagcatcatatttatatttgtggttgctggtttgcggaattgctgtgacagtggtaaacgcggcattagtagatctgtaccctacacaactcagggcaatggcagtatgtatatctttaatgatgggtcgattaggaagtgttgttggaagcaatgttgtaggaataattctagattataattgcgatttaacatttttaatatcaggaacatctctgatagcatgtggagtgattgcattctttataccgaacatttatcagaagcaagtggatagaagaacgagcattgcttcatatggacca

SEQ ID NO: 1905 - DNA, 1590 bp, Ctenocephalides felis
tggtccatatgaagcaatgctcgttcttctatccacttgcttctgataaatgttcggtataaagaatgcaatcactccacatgctatcagagatgttcctgatattaaaaatgttaaatcgcaattataatctagaattattcctacaacattgcttccaacaacacttcctaatcgacccatcattaaagatatacatactgccattgccctgagttgtgtagggtacagatctactaatgccgcgtttaccactgtcacagcaattccgcaaaccagcaaccacaaatataaatatgatgctattgttaaatgttcaataaatgcacaaattattccacaaatcccgcatgagaccatcacgaatacaagaattggaagctttcccacagagttaataatagcacctattatgggaaatccaatcgcatatccagcttccaacattaaagaatgcataaatgcctgttcttccattgtgtctttacactcggtcgtactattcgtagtatcaatgaagtcgtccgccctaagcattgatgaattttggacaacgtagcatattgtacttggtactcctggatgagcgttttgaaattctgtcattttacttatgatatcgggaaaccacatgtacatgccgttagatgtggcaaatattccgaattgcagagtacatgcaatgagtgtttttttcatgtgctcacccataaacagcggagcagtttgatcccatacagttcttaaaaatgatttctttgttttatttgtattttcaccatccactcctggatattcatctaagattgatgatacggggaattcactttctggtttaccagtattaattctatacattttggcaataatttgacgagcttcttcgtttcttccctgattcatcaaaaatttgggactttctggtaatttccacaaagcaaaacaacaaagcagtgatggcaaaccacatgcaaccatatacaacctccagggcttgtatgtatatcccaaaaagtcaatatagaatgaccatttctgatttataattaaccatgcaaccgtcggtaatgcaagacacgcaaatccgaagatgcttgacgctcccataatagccctgctgcgatgcctaggattatgaaattctcctaaatatgcatatattgttgcacttcctccagatacgaaaaatccattgaaatatcgcagcaaaataaacagccaaactgaatttacaaaactagatgccaaggtacaaaaaaatgcaagaagaagtgtaggcataatcactttccgcctccctctcgtatcggctaaaaatccccataaatgtgaactgcttataatacctataaaagctatagcgcttaatattcctttttgttttgttgttaattccagatcacattgtgctgaaggaacgacaaaactcattccaagagtttccatcaaaacacatactaatacgcatccactcacgaccagaagaaggtaattgaattttccaaaacctgtgagtgccaacgcatcttcaaactgccttggttttggttctttggaagctattatttgaatccccgtgttactgtccat

SEQ ID NO: 1906 - DNA, 381 bp, Ctenocephalides felis
acgttatatcgtgcccttaatggcagcagctatggcttccaaatgggttggtgatgctttgggcagacagggtatatatgatgcccatatacagcttaatggatatccattcttggacagtaaagatgaatttgcacatacatctttagctgcagatgtcatgcaacccaagaggaatgaaacattaagtgtaatcactcaagactcgatgactgtggatgatgttgaaggtttactgaaagaaactgagcacaatggatatccagttgttgtttccagagaatctcagtatcttgttggatttgttttgaggagggacttaaatctagccatagccaatgctagacgcatgatcgatgggataacaggacaaagtttggt

SEQ ID NO: 1907 - DNA, 381 bp, Ctenocephalides felis
accaaactttgtcctgttatcccatcgatcatgcgtctagcattggctatggctagatttaagtccctcctcaaaacaaatccaacaagatactgagattctctggaaacaacaactggatatccattgtgctcagtttctttcagtaaaccttcaacatcatccacagtcatcgagtcttgagtgattacacttaatgtttcattcctcttgggttgcatgacatctgcagctaaagatgtatgtgcaaattcatctttactgtccaagaatggatatccattaagctgtatatgggcatcatatataccctgtctgcccaaagcatcaccaacccatttggaagccatagctgctgccattaagggcacgatataacgt

SEQ ID NO: 1908 - DNA, 2191 bp, Ctenocephalides felis
atttttgcttctttggcagcctctttggtgcgcatgtttgcaccttatgcttgtgggtcaggtataccagagattaaaaccattctgagtggtttcatcatcagaggatatcttggaaaatggacattgattattaaaagtgtaggaatcatgttgtctgtatcagctggattgagtttgggtaaagaaggtcctatggtacacattgccagctgtataggtaatatattgtcttatttatttcctaaatatggtcggaatgaagcaaagaaacgagagattttatcagcagctgcagcagctggtgtatctgttgcatttggagcacctattggaggtgtgcttttcagtttggaagaggtgagctactatttcccattgaagaccttatggagatcattcttctgtgctttgatagcagctttcatattgcgatccataaatccatttggaaatgagcactctgtccttttctatgtggaatacaataaaccttggatattttttgaactgatacctttcataggccttggaataattggtggtgttgtagcaacgctgtttataaaagctaatttgtactggtgtcgctaccgtaaattttctaaactaggacagtaccccgttgcagaagttttagttgttgctgttgcaacagcagtgattgcttatcctaatccttacaccaggatgaatactagtcaactgatttatttactattcagccaatgcgggatttccaattctgatcctttgtgtgattacaatcgcaatttcactgatgttaaatcagctatagaaatagcagcagctggtcctggtgtctaccaggctgtgtggttgctcctgattgctttggtactgaaattgggaatgactgtatttacctttggtatgaaagtaccatgtggtctgtttatcccaagtttatgcctaggagctattatgggtagaattgtgggcattggaattgaacaattggcttactattatccaaaattatggttcttttctggtgaatgctcaactggagacaattgcatcacaccgggcctgtatgctatggtgggcgctgcagctgttttaggtggtgtcactagaatgacagtttctctggtggtaataatgtttgaactgactggtggtgtacgttatatcgtgcccttaatggcagcagctatggcttccaaatgggttggtgatgctttgggcagacagggtatatatgatgcccatatacagcttaatggatatccattcttggacagtaaagatgaatttgcacatacatctttagctgcagatgtcatgcaacccaagaggaatgaaacattaagtgtaatcactcaagactcgatgactgtggatgatgttgaaggtttactgaaagaaactgagcacaatggatatccagttgttgtttccagagaatctcagtatcttgttggatttgttttgaggagggacttaaatctagccatagccaatgctagacgcatgatcgatgggataacaggacaaagtttggtacttttcataaatggccctacagtgcaaagtttaggacctccacctttgaaactaaagaaaatattagatatggctccaataacagtgactgatcaaacaccaatggaaactgtggtggatatgtttagaaaactaggtttacgtcagacattagtcacacacaatgggcgtttgctcggtgttataactaaaaaagatgttttacgacatgtaaaacaaatggataatgaagatcctaatagtatactttttaattaatatttacatatatgtattaaataataaatgttaagttgcataaaaatccataaaactatgtaggtgtacattttaatggctattcttcatatacctaaatgaaaagactaaaaagaaaccaatttttaaaatatttaggtatttgatataatacatatttattttaatatgaatagtattttgtgtaatttaattgaaggcatcacaaattaaattgtgtaattgttataacagaatcagagtgtatatattagatttatcgattcgaaatttgtacaaaatgtatctcagttttttttaatgaggacttagaaaattttattgttaattgattatttttttagtattattttagtatttgtaactgattattaaacgattgattataaaaaaaaaaaaaaaa

SEQ ID NO: 1909 - DNA, 2191 bp, Ctenocephalides felis
ttttttttttttttttataatcaatcgtttaataatcagttacaaatactaaaataatactaaaaaaataatcaattaacaataaaattttctaagtcctcattaaaaaaaactgagatacattttgtacaaatttcgaatcgataaatctaatatatacactctgattctgttataacaattacacaatttaatttgtgatgccttcaattaaattacacaaaatactattcatattaaaataaatatgtattatatcaaatacctaaatattttaaaaattggtttctttttagtcttttcatttaggtatatgaagaatagccattaaaatgtacacctacatagttttatggatttttatgcaacttaacatttattatttaatacatatatgtaaatattaattaaaaagtatactattaggatcttcattatccatttgttttacatgtcgtaaaacatcttttttagttataacaccgagcaaacgcccattgtgtgtgactaatgtctgacgtaaacctagttttctaaacatatccaccacagtttccattggtgtttgatcagtcactgttattggagccatatctaatattttctttagtttcaaaggtggaggtcctaaactttgcactgtagggccatttatgaaaagtaccaaactttgtcctgttatcccatcgatcatgcgtctagcattggctatggctagatttaagtccctcctcaaaacaaatccaacaagatactgagattctctggaaacaacaactggatatccattgtgctcagtttctttcagtaaaccttcaacatcatccacagtcatcgagtcttgagtgattacacttaatgtttcattcctcttgggttgcatgacatctgcagctaaagatgtatgtgcaaattcatctttactgtccaagaatggatatccattaagctgtatatgggcatcatatataccctgtctgcccaaagcatcaccaacccatttggaagccatagctgctgccattaagggcacgatataacgtacaccaccagtcagttcaaacattattaccaccagagaaactgtcattctagtgacaccacctaaaacagctgcagcgcccaccatagcatacaggcccggtgtgatgcaattgtctccagttgagcattcaccagaaaagaaccataattttggataatagtaagccaattgttcaattccaatgcccacaattctacccataatagctcctaggcataaacttgggataaacagaccacatggtactttcataccaaaggtaaatacagtcattcccaatttcagtaccaaagcaatcaggagcaaccacacagcctggtagacaccaggaccagctgctgctatttctatagctgatttaacatcagtgaaattgcgattgtaatcacacaaaggatcagaattggaaatcccgcattggctgaatagtaaataaatcagttgactagtattcatcctggtgtaaggattaggataagcaatcactgctgttgcaacagcaacaactaaaacttctgcaacggggtactgtcctagtttagaaaatttacggtagcgacaccagtacaaattagcttttataaacagcgttgctacaacaccaccaattattccaaggcctatgaaaggtatcagttcaaaaaatatccaaggtttattgtattccacatagaaaaggacagagtgctcatttccaaatggatttatggatcgcaatatgaaagctgctatcaaagcacagaagaatgatctccataaggtcttcaatgggaaatagtagctcacctcttccaaactgaaaagcacacctccaataggtgctccaaatgcaacagatacaccagctgctgcagctgctgataaaatctctcgtttctttgcttcattccgaccatatttaggaaataaataagacaatatattacctatacagctggcaatgtgtaccataggaccttctttacccaaactcaatccagctgatacagacaacatgattcctacacttttaataatcaatgtccattttccaagatatcctctgatgatgaaaccactcagaatggttttaatctctggtatacctgacccacaagcataaggtgcaaacatgcgcaccaaagaggctgccaaagaagcaaaaat

SEQ ID NO: 1910 - DNA, 1968 bp, Ctenocephalides felis
gtggtggcatatcatttgctggtatgcaagctgaaagcgatgatattcctgggattgggcaatatgatgatttccatacgatagattggcaacgtgatatagccagagatcgaatgagacatcgatatattgttaaaaaacgacaagactctatactagacctgataaagggtgcccatgatgcctggtcaggttgggtgtgtgttctcctagtcgggctggtgacaggagctattgcaggcgtcatagatatcggagcaagttggatgacggatttaaagaacggtgtttgcccacaagcattctggttgaatagagaacaatgttgttggtcattgaatgaaacaacctttgatgatggaaattgctcacaatggctgacttggcctgaggttttcggacaacctagaactggggcgggggcttacataattgcttatttgttttatattatttgggcattgatttttgcttctttggcagcctctttggtgcgcatgtttgcaccttatgcttgtgggtcaggtataccagagattaaaaccattctgagtggtttcatcatcagaggatatcttggaaaatggacattgattattaaaagtgtaggaatcatgttgtctgtatcagctggattgagtttgggtaaagaaggtcctatggtacacattgccagctgtataggtaatatattgtcttatttatttcctaaatatggtcggaatgaagcaaagaaacgagagattttatcagcagctgcagcagctggtgtatctgttgcatttggagcacctattggaggtgtgcttttcagtttggaagaggtgagctactatttcccattgaagaccttatggagatcattcttctgtgctttgatagcagctttcatattgcgatccataaatccatttggaaatgagcactctgtccttttctatgtggaatacaataaaccttggatattttttgaactgatacctttcataggccttggaataattggtggtgttgtagcaacgctgtttataaaagctaatttgtactggtgtcgctaccgtaaattttctaaactaggacagtaccccgttgcagaagttttagttgttgctgttgcaacagcagtgattgcttatcctaatccttacaccaggatgaatactagtcaactgatttatttactattcagccaatgcgggatttccaattctgatcctttgtgtgattacaatcgcaatttcactgatgttaaatcagctatagaaatagcagcagctggtcctggtgtctaccaggctgtgtggttgctcctgattgctttggtactgaaattgggaatgactgtatttacctttggtatgaaagtaccatgtggtctgtttatcccaagtttatgcctaggagctattatgggtagaattgtgggcattggaattgaacaattggcttactattatccaaaattatggttcttttctggtgaatgctcaactggagacaattgcatcacaccgggcctgtatgctatggtgggcgctgcagctgttttaggtggtgtcactagaatgacagtttctctggtggtaataatgtttgaactgactggtggtgtacgttatatcgtgcccttaatggcagcagctatggcttccaaatgggttggtgatgctttgggcagacagggtatatatgatgcccatatacagcttaatggatatccattcttggacagtaaagatgaatttgcacatacatctttagctgcagatgtcatgcaacccaagaggaatgaaacattaagtgtaatcactcaagactcgatgactgtggatgatgttgaaggtttactgaaagaaactgagcacaatggatatccagttgttgtttccagagaatctcagtatcttgttggatttgttttgaggagggacttaaatctagccatagccaatgctagacgcatgatcg

SEQ ID NO: 1911 - DNA, 1968 bp, Ctenocephalides felis
cgatcatgcgtctagcattggctatggctagatttaagtccctcctcaaaacaaatccaacaagatactgagattctctggaaacaacaactggatatccattgtgctcagtttctttcagtaaaccttcaacatcatccacagtcatcgagtcttgagtgattacacttaatgtttcattcctcttgggttgcatgacatctgcagctaaagatgtatgtgcaaattcatctttactgtccaagaatggatatccattaagctgtatatgggcatcatatataccctgtctgcccaaagcatcaccaacccatttggaagccatagctgctgccattaagggcacgatataacgtacaccaccagtcagttcaaacattattaccaccagagaaactgtcattctagtgacaccacctaaaacagctgcagcgcccaccatagcatacaggcccggtgtgatgcaattgtctccagttgagcattcaccagaaaagaaccataattttggataatagtaagccaattgttcaattccaatgcccacaattctacccataatagctcctaggcataaacttgggataaacagaccacatggtactttcataccaaaggtaaatacagtcattcccaatttcagtaccaaagcaatcaggagcaaccacacagcctggtagacaccaggaccagctgctgctatttctatagctgatttaacatcagtgaaattgcgattgtaatcacacaaaggatcagaattggaaatcccgcattggctgaatagtaaataaatcagttgactagtattcatcctggtgtaaggattaggataagcaatcactgctgttgcaacagcaacaactaaaacttctgcaacggggtactgtcctagtttagaaaatttacggtagcgacaccagtacaaattagcttttataaacagcgttgctacaacaccaccaattattccaaggcctatgaaaggtatcagttcaaaaaatatccaaggtttattgtattccacatagaaaaggacagagtgctcatttccaaatggatttatggatcgcaatatgaaagctgctatcaaagcacagaagaatgatctccataaggtcttcaatgggaaatagtagctcacctcttccaaactgaaaagcacacctccaataggtgctccaaatgcaacagatacaccagctgctgcagctgctgataaaatctctcgtttctttgcttcattccgaccatatttaggaaataaataagacaatatattacctatacagctggcaatgtgtaccataggaccttctttacccaaactcaatccagctgatacagacaacatgattcctacacttttaataatcaatgtccattttccaagatatcctctgatgatgaaaccactcagaatggttttaatctctggtatacctgacccacaagcataaggtgcaaacatgcgcaccaaagaggctgccaaagaagcaaaaatcaatgcccaaataatataaaacaaataagcaattatgtaagcccccgccccagttctaggttgtccgaaaacctcaggccaagtcagccattgtgagcaatttccatcatcaaaggttgtttcattcaatgaccaacaacattgttctctattcaaccagaatgcttgtgggcaaacaccgttctttaaatccgtcatccaacttgctccgatatctatgacgcctgcaatagctcctgtcaccagcccgactaggagaacacacacccaacctgaccaggcatcatgggcaccctttatcaggtctagtatagagtcttgtcgttttttaacaatatatcgatgtctcattcgatctctggctatatcacgttgccaatctatcgtatggaaatcatcatattgcccaatcccaggaatatcatcgctttcagcttgcataccagcaaatgatatgccaccac

SEQ ID NO: 1912 - DNA, 673 bp, Ctenocephalides felis
tactcactatatggctcgagcggccgcccgggcagtcgtttttgttagaaaaagtacaaaaattanttaatgtaacagtgcttgtgatataaaaaataatgattcaagtgcatcatatttaaatcaattaatttttttaaaatcttagaaatgaatttaaagcagctatggagaaatatccattaaaaggaaattctacgatacgtttaagtggtcctgcttcttatcaatcggttactaaaaaaaaacgcccaggagactccactaatcacatagtggaacgagtggatcatcctttgagcggcacgatgccctcggacggaccccaacagcataatccagtgtcggactcgggcgatttttcgccagacgaattcggcaaacgtatatttcctcccggatccacacagttgaccctggatgatgataatggatcagcaaatttggcaattaaatttgagggtctttctagtggtggcatatcatttgctggtatgcaagctgaaagcgatgatattcctgggattgggcaatatgatgatttccatacgatagattggcaacgtgatatagccagagatcgaatgagacatcgatatattgttaaaaaacgacaagactctatactagacctgataaagggtgcccatgatgcctggtcaggttgggtgtg

SEQ ID NO: 1913 - DNA, 673 bp, Ctenocephalides felis
cacacccaacctgaccaggcatcatgggcaccctttatcaggtctagtatagagtcttgtcgttttttaacaatatatcgatgtctcattcgatctctggctatatcacgttgccaatctatcgtatggaaatcatcatattgcccaatcccaggaatatcatcgctttcagcttgcataccagcaaatgatatgccaccactagaaagaccctcaaatttaattgccaaatttgctgatccattatcatcatccagggtcaactgtgtggatccgggaggaaatatacgtttgccgaattcgtctggcgaaaaatcgcccgagtccgacactggattatgctgttggggtccgtccgagggcatcgtgccgctcaaaggatgatccactcgttccactatgtgattagtggagtctcctgggcgtttttttttagtaaccgattgataagaagcaggaccacttaaacgtatcgtagaatttccttttaatggatatttctccatagctgctttaaattcatttctaagattttaaaaaaattaattgatttaaatatgatgcacttgaatcattattttttatatcacaagcactgttacattaantaatttttgtactttttctaacaaaaacgactgcccgggcggccgctcgagccatatagtgagta

SEQ ID NO: 1914 - DNA, 3126 bp, Ctenocephalides felis
  CDS (168)..(2720)
tactcactatatggctcgagcggccgcccgggcagtcgtttttgttagaaaaagtacaaaaattanttaatgtaacagtgcttgtgatataaaaaataatgattcaagtgcatcatatttaaatcaattaatttttttaaaatcttagaaatgaatttaaagcagctatggagaaatatccattaaaaggaaattctacgatacgtttaagtggtcctgcttcttatcaatcggttactaaaaaaaaacgcccaggagactccactaatcacatagtggaacgagtggatcatcctttgagcggcacgatgccctcggacggaccccaacagcataatccagtgtcggactcgggcgatttttcgccagacgaattcggcaaacgtatatttcctcccggatccacacagttgaccctggatgatgataatggatcagcaaatttggcaattaaatttgagggtctttctagtggtggcatatcatttgctggtatgcaagctgaaagcgatgatattcctgggattgggcaatatgatgatttccatacgatagattggcaacgtgatatagccagagatcgaatgagacatcgatatattgttaaaaaacgacaagactctatactagacctgataaagggtgcccatgatgcctggtcaggttgggtgtgtgttctcctagtcgggctggtgacaggagctattgcaggcgtcatagatatcggagcaagttggatgacggatttaaagaacggtgtttgcccacaagcattctggttgaatagagaacaatgttgttggtcattgaatgaaacaacctttgatgatggaaattgctcacaatggctgacttggcctgaggttttcggacaacctagaactggggcgggggcttacataattgcttatttgttttatattatttgggcattgatttttgcttctttggcagcctctttggtgcgcatgtttgcaccttatgcttgtgggtcaggtataccagagattaaaaccattctgagtggtttcatcatcagaggatatcttggaaaatggacattgattattaaaagtgtaggaatcatgttgtctgtatcagctggattgagtttgggtaaagaaggtcctatggtacacattgccagctgtataggtaatatattgtcttatttatttcctaaatatggtcggaatgaagcaaagaaacgagagattttatcagcagctgcagcagctggtgtatctgttgcatttggagcacctattggaggtgtgcttttcagtttggaagaggtgagctactatttcccattgaagaccttatggagatcattcttctgtgctttgatagcagctttcatattgcgatccataaatccatttggaaatgagcactctgtccttttctatgtggaatacaataaaccttggatattttttgaactgatacctttcataggccttggaataattggtggtgttgtagcaacgctgtttataaaagctaatttgtactggtgtcgctaccgtaaattttctaaactaggacagtaccccgttgcagaagttttagttgttgctgttgcaacagcagtgattgcttatcctaatccttacaccaggatgaatactagtcaactgatttatttactattcagccaatgcgggatttccaattctgatcctttgtgtgattacaatcgcaatttcactgatgttaaatcagctatagaaatagcagcagctggtcctggtgtctaccaggctgtgtggttgctcctgattgctttggtactgaaattgggaatgactgtatttacctttggtatgaaagtaccatgtggtctgtttatcccaagtttatgcctaggagctattatgggtagaattgtgggcattggaattgaacaattggcttactattatccaaaattatggttcttttctggtgaatgctcaactggagacaattgcatcacaccgggcctgtatgctatggtgggcgctgcagctgttttaggtggtgtcactagaatgacagtttctctggtggtaataatgtttgaactgactggtggtgtacgttatatcgtgcccttaatggcagcagctatggcttccaaatgggttggtgatgctttgggcagacagggtatatatgatgcccatatacagcttaatggatatccattcttggacagtaaagatgaatttgcacatacatctttagctgcagatgtcatgcaacccaagaggaatgaaacattaagtgtaatcactcaagactcgatgactgtggatgatgttgaaggtttactgaaagaaactgagcacaatggatatccagttgttgtttccagagaatctcagtatcttgttggatttgttttgaggagggacttaaatctagccatagccaatgctagacgcatgatcgatgggataacaggacaaagtttggtacttttcataaatggccctacagtgcaaagtttaggacctccacctttgaaactaaagaaaatattagatatggctccaataacagtgactgatcaaacaccaatggaaactgtggtggatatgtttagaaaactaggtttacgtcagacattagtcacacacaatgggcgtttgctcggtgttataactaaaaaagatgttttacgacatgtaaaacaaatggataatgaagatcctaatagtatactttttaattaatatttacatatatgtattaaataataaatgttaagttgcataaaaatccataaaactatgtaggtgtacattttaatggctattcttcatatacctaaatgaaaagactaaaaagaaaccaatttttaaaatatttaggtatttgatataatacatatttattttaatatgaatagtattttgtgtaatttaattgaaggcatcacaaattaaattgtgtaattgttataacagaatcagagtgtatatattagatttatcgattcgaaatttgtacaaaatgtatctcagttttttttaatgaggacttagaaaattttattgttaattgattatttttttagtattattttagtatttgtaactgattattaaacgattgattataaaaaaaaaaaaaaaa

SEQ ID NO: 1915 - protein, 851 aa, Ctenocephalides felis
MEKYPLKGNSTIRLSGPASYQSVTKKKRPGDSTNHIVERVDHPLSGTMPSDGPQQHNPVSDSGDFSPDEFGKRIFPPGSTQLTLDDDNGSANLAIKFEGLSSGGISFAGMQAESDDIPGIGQYDDFHTIDWQRDIARDRMRHRYIVKKRQDSILDLIKGAHDAWSGWVCVLLVGLVTGAIAGVIDIGASWMTDLKNGVCPQAFWLNREQCCWSLNETTFDDGNCSQWLTWPEVFGQPRTGAGAYIIAYLFYIIWALIFASLAASLVRMFAPYACGSGIPEIKTILSGFIIRGYLGKWTLIIKSVGIMLSVSAGLSLGKEGPMVHIASCIGNILSYLFPKYGRNEAKKREILSAAAAAGVSVAFGAPIGGVLFSLEEVSYYFPLKTLWRSFFCALIAAFILRSINPFGNEHSVLFYVEYNKPWIFFELIPFIGLGIIGGVVATLFIKANLYWCRYRKFSKLGQYPVAEVLVVAVATAVIAYPNPYTRMNTSQLIYLLFSQCGISNSDPLCDYNRNFTDVKSAIEIAAAGPGVYQAVWLLLIALVLKLGMTVFTFGMKVPCGLFIPSLCLGAIMGRIVGIGIEQLAYYYPKLWFFSGECSTGDNCITPGLYAMVGAAAVLGGVTRMTVSLVVIMFELTGGVRYIVPLMAAAMASKWVGDALGRQGIYDAHIQLNGYPFLDSKDEFAHTSLAADVMQPKRNETLSVITQDSMTVDDVEGLLKETEHNGYPVVVSRESQYLVGFVLRRDLNLAIANARRMIDGITGQSLVLFINGPTVQSLGPPPLKLKKILDMAPITVTDQTPMETVVDMFRKLGLRQTLVTHNGRLLGVITKKDVLRHVKQMDNEDPNSILFN

SEQ ID NO: 1916 - DNA, 3126 bp, Ctenocephalides felis; identical to SEQ ID NO: 1914

SEQ ID NO: 1917 - DNA, 2553 bp, Ctenocephalides felis
atggagaaatatccattaaaaggaaattctacgatacgtttaagtggtcctgcttcttatcaatcggttactaaaaaaaaacgcccaggagactccactaatcacatagtggaacgagtggatcatcctttgagcggcacgatgccctcggacggaccccaacagcataatccagtgtcggactcgggcgatttttcgccagacgaattcggcaaacgtatatttcctcccggatccacacagttgaccctggatgatgataatggatcagcaaatttggcaattaaatttgagggtctttctagtggtggcatatcatttgctggtatgcaagctgaaagcgatgatattcctgggattgggcaatatgatgatttccatacgatagattggcaacgtgatatagccagagatcgaatgagacatcgatatattgttaaaaaacgacaagactctatactagacctgataaagggtgcccatgatgcctggtcaggttgggtgtgtgttctcctagtcgggctggtgacaggagctattgcaggcgtcatagatatcggagcaagttggatgacggatttaaagaacggtgtttgcccacaagcattctggttgaatagagaacaatgttgttggtcattgaatgaaacaacctttgatgatggaaattgctcacaatggctgacttggcctgaggttttcggacaacctagaactggggcgggggcttacataattgcttatttgttttatattatttgggcattgatttttgcttctttggcagcctctttggtgcgcatgtttgcaccttatgcttgtgggtcaggtataccagagattaaaaccattctgagtggtttcatcatcagaggatatcttggaaaatggacattgattattaaaagtgtaggaatcatgttgtctgtatcagctggattgagtttgggtaaagaaggtcctatggtacacattgccagctgtataggtaatatattgtcttatttatttcctaaatatggtcggaatgaagcaaagaaacgagagattttatcagcagctgcagcagctggtgtatctgttgcatttggagcacctattggaggtgtgcttttcagtttggaagaggtgagctactatttcccattgaagaccttatggagatcattcttctgtgctttgatagcagctttcatattgcgatccataaatccatttggaaatgagcactctgtccttttctatgtggaatacaataaaccttggatattttttgaactgatacctttcataggccttggaataattggtggtgttgtagcaacgctgtttataaaagctaatttgtactggtgtcgctaccgtaaattttctaaactaggacagtaccccgttgcagaagttttagttgttgctgttgcaacagcagtgattgcttatcctaatccttacaccaggatgaatactagtcaactgatttatttactattcagccaatgcgggatttccaattctgatcctttgtgtgattacaatcgcaatttcactgatgttaaatcagctatagaaatagcagcagctggtcctggtgtctaccaggctgtgtggttgctcctgattgctttggtactgaaattgggaatgactgtatttacctttggtatgaaagtaccatgtggtctgtttatcccaagtttatgcctaggagctattatgggtagaattgtgggcattggaattgaacaattggcttactattatccaaaattatggttcttttctggtgaatgctcaactggagacaattgcatcacaccgggcctgtatgctatggtgggcgctgcagctgttttaggtggtgtcactagaatgacagtttctctggtggtaataatgtttgaactgactggtggtgtacgttatatcgtgcccttaatggcagcagctatggcttccaaatgggttggtgatgctttgggcagacagggtatatatgatgcccatatacagcttaatggatatccattcttggacagtaaagatgaatttgcacatacatctttagctgcagatgtcatgcaacccaagaggaatgaaacattaagtgtaatcactcaagactcgatgactgtggatgatgttgaaggtttactgaaagaaactgagcacaatggatatccagttgttgtttccagagaatctcagtatcttgttggatttgttttgaggagggacttaaatctagccatagccaatgctagacgcatgatcgatgggataacaggacaaagtttggtacttttcataaatggccctacagtgcaaagtttaggacctccacctttgaaactaaagaaaatattagatatggctccaataacagtgactgatcaaacaccaatggaaactgtggtggatatgtttagaaaactaggtttacgtcagacattagtcacacacaatgggcgtttgctcggtgttataactaaaaaagatgttttacgacatgtaaaacaaatggataatgaagatcctaatagtatactttttaat

SEQ ID NO: 1918 - DNA, 2553 bp, Ctenocephalides felis
attaaaaagtatactattaggatcttcattatccatttgttttacatgtcgtaaaacatcttttttagttataacaccgagcaaacgcccattgtgtgtgactaatgtctgacgtaaacctagttttctaaacatatccaccacagtttccattggtgtttgatcagtcactgttattggagccatatctaatattttctttagtttcaaaggtggaggtcctaaactttgcactgtagggccatttatgaaaagtaccaaactttgtcctgttatcccatcgatcatgcgtctagcattggctatggctagatttaagtccctcctcaaaacaaatccaacaagatactgagattctctggaaacaacaactggatatccattgtgctcagtttctttcagtaaaccttcaacatcatccacagtcatcgagtcttgagtgattacacttaatgtttcattcctcttgggttgcatgacatctgcagctaaagatgtatgtgcaaattcatctttactgtccaagaatggatatccattaagctgtatatgggcatcatatataccctgtctgcccaaagcatcaccaacccatttggaagccatagctgctgccattaagggcacgatataacgtacaccaccagtcagttcaaacattattaccaccagagaaactgtcattctagtgacaccacctaaaacagctgcagcgcccaccatagcatacaggcccggtgtgatgcaattgtctccagttgagcattcaccagaaaagaaccataattttggataatagtaagccaattgttcaattccaatgcccacaattctacccataatagctcctaggcataaacttgggataaacagaccacatggtactttcataccaaaggtaaatacagtcattcccaatttcagtaccaaagcaatcaggagcaaccacacagcctggtagacaccaggaccagctgctgctatttctatagctgatttaacatcagtgaaattgcgattgtaatcacacaaaggatcagaattggaaatcccgcattggctgaatagtaaataaatcagttgactagtattcatcctggtgtaaggattaggataagcaatcactgctgttgcaacagcaacaactaaaacttctgcaacggggtactgtcctagtttagaaaatttacggtagcgacaccagtacaaattagcttttataaacagcgttgctacaacaccaccaattattccaaggcctatgaaaggtatcagttcaaaaaatatccaaggtttattgtattccacatagaaaaggacagagtgctcatttccaaatggatttatggatcgcaatatgaaagctgctatcaaagcacagaagaatgatctccataaggtcttcaatgggaaatagtagctcacctcttccaaactgaaaagcacacctccaataggtgctccaaatgcaacagatacaccagctgctgcagctgctgataaaatctctcgtttctttgcttcattccgaccatatttaggaaataaataagacaatatattacctatacagctggcaatgtgtaccataggaccttctttacccaaactcaatccagctgatacagacaacatgattcctacacttttaataatcaatgtccattttccaagatatcctctgatgatgaaaccactcagaatggttttaatctctggtatacctgacccacaagcataaggtgcaaacatgcgcaccaaagaggctgccaaagaagcaaaaatcaatgcccaaataatataaaacaaataagcaattatgtaagcccccgccccagttctaggttgtccgaaaacctcaggccaagtcagccattgtgagcaatttccatcatcaaaggttgtttcattcaatgaccaacaacattgttctctattcaaccagaatgcttgtgggcaaacaccgttctttaaatccgtcatccaacttgctccgatatctatgacgcctgcaatagctcctgtcaccagcccgactaggagaacacacacccaacctgaccaggcatcatgggcaccctttatcaggtctagtatagagtcttgtcgttttttaacaatatatcgatgtctcattcgatctctggctatatcacgttgccaatctatcgtatggaaatcatcatattgcccaatcccaggaatatcatcgctttcagcttgcataccagcaaatgatatgccaccactagaaagaccctcaaatttaattgccaaatttgctgatccattatcatcatccagggtcaactgtgtggatccgggaggaaatatacgtttgccgaattcgtctggcgaaaaatcgcccgagtccgacactggattatgctgttggggtccgtccgagggcatcgtgccgctcaaaggatgatccactcgttccactatgtgattagtggagtctcctgggcgtttttttttagtaaccgattgataagaagcaggaccacttaaacgtatcgtagaatttccttttaatggatatttctccat

SEQ ID NO: 1919 - DNA, 1181 bp, Ctenocephalides canis
  CDS (127)..(432)
acatcacagaccgtcgacatataaacacaaccgaaatctcctatcacagtgtacggagtgtaaaatattgttgaagtattttgaaatttattaatttattcgaaaaggagatttcattaaataaaaatggtttacgaaagtgacttttacacgacccgtcggccctacagtcgtccggctttgtcttcatactccgtaacgacgccgtcccgtcattacgtggtgactgacactccatctagaccaagggtagcggaagagcaatattcttactcctaccgcagccagcaggaaagatcttctgcagatccctacggcaggaactattcgacaacctccaccaccgaaagcacaagacgtgcagggggttatccaggatctgactattcttacacgagcgaacgctcatccaagaactggagatggaccaggtagttacagatccagctatagctccactacttctggacgtcttcctggaggaaccacttaccgtcacttctcataccgtgtgtaaacacgaaaattgaaaaattttgttttgataaattggtttttatttgaagtctcataagaactaaaagaattttttttataatttttatttttttgctatgaattattattactattatagcactcatattaatatcctgaaaatgtaaaacaaaactatgatttctgatcaaacaaccaattttatcatcactgatttttatcatatcctaggatgatgtaatattgtagtccttggaaagttataccagaagaagactcaatatgctattctgtgtaattattaatataacttaatattatttttatttatttaattaattagcaatgtctactaaaaattgtctaaaattagcttttaattttccctagatatattatcataaaaaccaaagattaggcatatttttgatactgtacaaattttcttgtgatataagtttacaatttgttttaatttttgttgaaacaaaatacgtaatggtattgcaattaataattatagatactaatagtgatgttgtaagagttaggactaatagatgagtcttcttcaattttgataaacatatttttataatctgtgttaaattttgcacttgtaatgctgtgctttttaatgaataaacatgcaatattaaaacttcaaaaaaaaaaaaaaaaaa

SEQ ID NO: 1920 - protein, 102 aa, Ctenocephalides canis
MVYESDFYTTRRPYSRPALSSYSVTTPSRHYVVTDTPSRPRVAEEQYSYSYRSQQERSSADPYGRNYSTTSTTESTRRAGGYPGSDYSYTSERSSKNWRWTR

SEQ ID NO: 1921 - DNA, 1181 bp, Ctenocephalides felis
ttttttttttttttttttgaagttttaatattgcatgtttattcattaaaaagcacagcattacaagtgcaaaatttaacacagattataaaaatatgtttatcaaaattgaagaagactcatctattagtcctaactcttacaacatcactattagtatctataattattaattgcaataccattacgtattttgtttcaacaaaaattaaaacaaattgtaaacttatatcacaagaaaatttgtacagtatcaaaaatatgcctaatctttggtttttatgataatatatctagggaaaattaaaagctaattttagacaatttttagtagacattgctaattaattaaataaataaaaataatattaagttatattaataattacacagaatagcatattgagtcttcttctggtataactttccaaggactacaatattacatcatcctaggatatgataaaaatcagtgatgataaaattggttgtttgatcagaaatcatagttttgttttacattttcaggatattaatatgagtgctataatagtaataataattcatagcaaaaaaataaaaattataaaaaaaattcttttagttcttatgagacttcaaataaaaaccaatttatcaaaacaaaatttttcaattttcgtgtttacacacggtatgagaagtgacggtaagtggttcctccaggaagacgtccagaagtagtggagctatagctggatctgtaactacctggtccatctccagttcttggatgagcgttcgctcgtgtaagaatagtcagatcctggataaccccctgcacgtcttgtgctttcggtggtggaggttgtcgaatagttcctgccgtagggatctgcagaagatctttcctgctggctgcggtaggagtaagaatattgctcttccgctacccttggtctagatggagtgtcagtcaccacgtaatgacgggacggcgtcgttacggagtatgaagacaaagccggacgactgtagggccgacgggtcgtgtaaaagtcactttcgtaaaccatttttatttaatgaaatctccttttcgaataaattaataaatttcaaaatacttcaacaatattttacactccgtacactgtgataggagatttcggttgtgtttatatgtcgacggtctgtgatgt

SEQ ID NO: 1922 - DNA, 306 bp, Ctenocephalides felis
atggtttacgaaagtgacttttacacgacccgtcggccctacagtcgtccggctttgtcttcatactccgtaacgacgccgtcccgtcattacgtggtgactgacactccatctagaccaagggtagcggaagagcaatattcttactcctaccgcagccagcaggaaagatcttctgcagatccctacggcaggaactattcgacaacctccaccaccgaaagcacaagacgtgcagggggttatccaggatctgactattcttacacgagcgaacgctcatccaagaactggagatggaccagg

SEQ ID NO: 1923 - DNA, 306 bp, Ctenocephalides felis
cctggtccatctccagttcttggatgagcgttcgctcgtgtaagaatagtcagatcctggataaccccctgcacgtcttgtgctttcggtggtggaggttgtcgaatagttcctgccgtagggatctgcagaagatctttcctgctggctgcggtaggagtaagaatattgctcttccgctacccttggtctagatggagtgtcagtcaccacgtaatgacgggacggcgtcgttacggagtatgaagacaaagccggacgactgtagggccgacgggtcgtgtaaaagtcactttcgtaaaccat

SEQ ID NO: 1924 - DNA, 2161 bp, Ctenocephalides felis
  CDS (107)..(907)
ggcaccaggtgagtacttgtactctaacaccgtgccaaagcctcaaacacactcgcctgcgctgggagttagtacacagtgatctccactggcaagcgattacacgatgactttcggaatttcagtaattctgttagtgtctatttggacaacaaatactcatgcatatttaacatcagtgcaagaattagacgatgccataagagcagtggtgtcacggatgcatcgagtagccgatattgaaagtggtggcgaatactcagatctgggagtagacttcccagtacccgcaattccacgatctcaaaaagctctagaatcggattcggaatatgattccatattcgatgaaggccagttacatcctagcctcagagatcaggaatatctccagcatagtcctctatggggtcagcagtacgtaagtggaggcgctggtgaaggccaacaaaggctcaaaccagatggaagtgcaatgaatcatcagcaagtaaaaacggataatctgcccgcttattgtaatccacctaatccctgtcctgttggattaacagaagagcatggttgcaccgagaacttcgagaacaccgcagccttcagccgcgactaccaggcggctcagcaatgcatgtgcgacggtgagcatatgttccgttgtccgtcctcattagacggagacgaactggacgactcatccgaatcagacgaacaggacgaacaccaggaccttctggacatggaaggcggacttgatactcgaactgcgcctgaaatcttcatggcgcaaagggagtaccgacgatctggcttgagtgggaataaacatcataaaagaaagagtactaatccctacttgcatggtgagaaactcccagtggctgctaagaagggtatcaacgttgtctactgaaccaatttaaaacgctcaccactaatttaacaaaatatatttttatttttttggataaaccaacccagaaacaaatgctaattaattttcagaaaaaagcatttgtaaacgactttggcaattgataaacggaataatgatttcaaaccgaataaacaaaagaaaaatctacaaaaataatttagttttcgttagtcattacatatgtattaccggttaaaaccctttattcgaaggagaattaagaactaataaaacaatgtttaatattaagtagccgtgtaacttactttgtgtaatattaaagaggcccattatataataattaaatttaatgtagtaaactatttataatatattaatattataaatacatcattaaaacatcaaattactaatgaaatctaatacaatgctattggaatccgattggggtatgatcaaatttcttattgtctttctctctattatttatttgcaagtttgttccgtaccccaggacgatttcaaatatagtctccatcaatgcgcgcatttgcgaaattaaaaaaagctcacaaaaatttaataaagtctcaattacatcccgagacaaatttgaaaaaggaagagttgcattaacaacaattcacattagaaaagaattgattggraaacttacacntgntttcggtgaacgtgtttcagaccccattgatgctcttgtatccgtgcaatgttcatttataatttccataatttaatatattatgaaaccattgtaatgtattgtattatccgatttttgtaatagacattacacgcaatgagtgcacgatacgtgtttaatgaaataagtgtatgttttaagatttgcattcactatttgacatagatataagtaattatatttatcaagcaaatcacttcgtatcatttctattatggatatataataatgatatactaatgtgaacaaaacatctcaaaatatttttaaaatataaatgtataattaaatttagaatacttttcgtgaactgtaataatttactcacagttcatgctaacgatcatgtgtctaaatacaattatgaagaagattatatattacatacatgtgaaatctatataataatgcatgcttgttaaatttatattataatgaatatataatgaatattttaaatataatatatatgcgcgttagttgtcaaataaaagtctatattgctcccactattggaaaaaaaaaaaaaaaaaaaaaaaaaa

SEQ ID NO: 1925 - protein, 267 aa, Ctenocephalides felis
MTFGISVILLVSIWTTNTHAYLTSVQELDDAIRAVVSRMHRVADIESGGEYSDLGVDFPVPAIPRSQKALESDSEYDSIFDEGQLHPSLRDQEYLQHSPLWGQQYVSGGAGEGQQRLKPDGSAMNHQQVKTDNLPAYCNPPNPCPVGLTEEHGCTENFENTAAFSRDYQAAQQCMCDGEHMFRCPSSLDGDELDDSSESDEQDEHQDLLDMEGGLDTRTAPEIFMAQREYRRSGLSGNKHHKRKSTNPYLHGEKLPVAAKKGINVVY

SEQ ID NO: 1926 - DNA, 2161 bp, Ctenocephalides felis
ttttttttttttttttttttttttttccaatagtgggagcaatatagacttttatttgacaactaacgcgcatatatattatatttaaaatattcattatatattcattataatataaatttaacaagcatgcattattatatagatttcacatgtatgtaatatataatcttcttcataattgtatttagacacatgatcgttagcatgaactgtgagtaaattattacagttcacgaaaagtattctaaatttaattatacatttatattttaaaaatattttgagatgttttgttcacattagtatatcattattatatatccataatagaaatgatacgaagtgatttgcttgataaatataattacttatatctatgtcaaatagtgaatgcaaatcttaaaacatacacttatttcattaaacacgtatcgtgcactcattgcgtgtaatgtctattacaaaaatcggataatacaatacattacaatggtttcataatatattaaattatggaaattataaatgaacattgcacggatacaagagcatcaatggggtctgaaacacgttcaccgaaancangtgtaagtttyccaatcaattcttttctaatgtgaattgttgttaatgcaactcttcctttttcaaatttgtctcgggatgtaattgagactttattaaatttttgtgagctttttttaatttcgcaaatgcgcgcattgatggagactatatttgaaatcgtcctggggtacggaacaaacttgcaaataaataatagagagaaagacaataagaaatttgatcataccccaatcggattccaatagcattgtattagatttcattagtaatttgatgttttaatgatgtatttataatattaatatattataaatagtttactacattaaatttaattattatataatgggcctctttaatattacacaaagtaagttacacggctacttaatattaaacattgttttattagttcttaattctccttcgaataaagggttttaaccggtaatacatatgtaatgactaacgaaaactaaattatttttgtagatttttcttttgtttattcggtttgaaatcattattccgtttatcaattgccaaagtcgtttacaaatgcttttttctgaaaattaattagcatttgtttctgggttggtttatccaaaaaaataaaaatatattttgttaaattagtggtgagcgttttaaattggttcagtagacaacgttgatacccttcttagcagccactgggagtttctcaccatgcaagtagggattagtactctttcttttatgatgtttattcccactcaagccagatcgtcggtactccctttgcgccatgaagatttcaggcgcagttcgagtatcaagtccgccttccatgtccagaaggtcctggtgttcgtcctgttcgtctgattcggatgagtcgtccagttcgtctccgtctaatgaggacggacaacggaacatatgctcaccgtcgcacatgcattgctgagccgcctggtagtcgcggctgaaggctgcggtgttctcgaagttctcggtgcaaccatgctcttctgttaatccaacaggacagggattaggtggattacaataagcgggcagattatccgtttttacttgctgatgattcattgcacttccatctggtttgagcctttgttggccttcaccagcgcctccacttacgtactgctgaccccatagaggactatgctggagatattcctgatctctgaggctaggatgtaactggccttcatcgaatatggaatcatattccgaatccgattctagagctttttgagatcgtggaattgcgggtactgggaagtctactcccagatctgagtattcgccaccactttcaatatcggctactcgatgcatccgtgacaccactgctcttatggcatcgtctaattcttgcactgatgttaaatatgcatgagtatttgttgtccaaatagacactaacagaattactgaaattccgaaagtcatcgtgtaatcgcttgccagtggagatcactgtgtactaactcccagcgcaggcgagtgtgtttgaggctttggcacggtgttagagtacaagtactcacctggtgcc

SEQ ID NO: 1927 - DNA, 801 bp, Ctenocephalides felis
atgactttcggaatttcagtaattctgttagtgtctatttggacaacaaatactcatgcatatttaacatcagtgcaagaattagacgatgccataagagcagtggtgtcacggatgcatcgagtagccgatattgaaagtggtggcgaatactcagatctgggagtagacttcccagtacccgcaattccacgatctcaaaaagctctagaatcggattcggaatatgattccatattcgatgaaggccagttacatcctagcctcagagatcaggaatatctccagcatagtcctctatggggtcagcagtacgtaagtggaggcgctggtgaaggccaacaaaggctcaaaccagatggaagtgcaatgaatcatcagcaagtaaaaacggataatctgcccgcttattgtaatccacctaatccctgtcctgttggattaacagaagagcatggttgcaccgagaacttcgagaacaccgcagccttcagccgcgactaccaggcggctcagcaatgcatgtgcgacggtgagcatatgttccgttgtccgtcctcattagacggagacgaactggacgactcatccgaatcagacgaacaggacgaacaccaggaccttctggacatggaaggcggacttgatactcgaactgcgcctgaaatcttcatggcgcaaagggagtaccgacgatctggcttgagtgggaataaacatcataaaagaaagagtactaatccctacttgcatggtgagaaactcccagtggctgctaagaagggtatcaacgttgtctac

SEQ ID NO: 1928 - DNA, 801 bp, Ctenocephalides felis
gtagacaacgttgatacccttcttagcagccactgggagtttctcaccatgcaagtagggattagtactctttcttttatgatgtttattcccactcaagccagatcgtcggtactccctttgcgccatgaagatttcaggcgcagttcgagtatcaagtccgccttccatgtccagaaggtcctggtgttcgtcctgttcgtctgattcggatgagtcgtccagttcgtctccgtctaatgaggacggacaacggaacatatgctcaccgtcgcacatgcattgctgagccgcctggtagtcgcggctgaaggctgcggtgttctcgaagttctcggtgcaaccatgctcttctgttaatccaacaggacagggattaggtggattacaataagcgggcagattatccgtttttacttgctgatgattcattgcacttccatctggtttgagcctttgttggccttcaccagcgcctccacttacgtactgctgaccccatagaggactatgctggagatattcctgatctctgaggctaggatgtaactggccttcatcgaatatggaatcatattccgaatccgattctagagctttttgagatcgtggaattgcgggtactgggaagtctactcccagatctgagtattcgccaccactttcaatatcggctactcgatgcatccgtgacaccactgctcttatggcatcgtctaattcttgcactgatgttaaatatgcatgagtatttgttgtccaaatagacactaacagaattactgaaattccgaaagtcat

SEQ ID NO: 1929 - DNA, 741 bp, Ctenocephalides felis
  CDS (1)..(741)
tatttaacatcagtgcaagaattagacgatgccataagagcagtggtgtcacggatgcatcgagtagccgatattgaaagtggtggcgaatactcagatctgggagtagacttcccagtacccgcaattccacgatctcaaaaagctctagaatcggattcggaatatgattccatattcgatgaaggccagttacatcctagcctcagagatcaggaatatctccagcatagtcctctatggggtcagcagtacgtaagtggaggcgctggtgaaggccaacaaaggctcaaaccagatggaagtgcaatgaatcatcagcaagtaaaaacggataatctgcccgcttattgtaatccacctaatccctgtcctgttggattaacagaagagcatggttgcaccgagaacttcgagaacaccgcagccttcagccgcgactaccaggcggctcagcaatgcatgtgcgacggtgagcatatgttccgttgtccgtcctcattagacggagacgaactggacgactcatccgaatcagacgaacaggacgaacaccaggaccttctggacatggaaggcggacttgatactcgaactgcgcctgaaatcttcatggcgcaaagggagtaccgacgatctggcttgagtgggaataaacatcataaaagaaagagtactaatccctacttgcatggtgagaaactcccagtggctgctaagaagggtatcaacgttgtctac

SEQ ID NO: 1930 - protein, 247 aa, Ctenocephalides felis
YLTSVQELDDAIRAVVSRMHRVADIESGGEYSDLGVDFPVPAIPRSQKALESDSEYDSIFDEGQLHPSLRDQEYLQHSPLWGQQYVSGGAGEGQQRLKPDGSAMNHQQVKTDNLPAYCNPPNPCPVGLTEEHGCTENFENTAAFSRDYQAAQQCMCDGEHMFRCPSSLDGDELDDSSESDEQDEHQDLLDMEGGLDTRTAPEIFMAQREYRRSGLSGNKHHKRKSTNPYLHGEKLPVAAKKGINVVY

SEQ ID NO: 1931 - DNA, 741 bp, Ctenocephalides felis
gtagacaacgttgatacccttcttagcagccactgggagtttctcaccatgcaagtagggattagtactctttcttttatgatgtttattcccactcaagccagatcgtcggtactccctttgcgccatgaagatttcaggcgcagttcgagtatcaagtccgccttccatgtccagaaggtcctggtgttcgtcctgttcgtctgattcggatgagtcgtccagttcgtctccgtctaatgaggacggacaacggaacatatgctcaccgtcgcacatgcattgctgagccgcctggtagtcgcggctgaaggctgcggtgttctcgaagttctcggtgcaaccatgctcttctgttaatccaacaggacagggattaggtggattacaataagcgggcagattatccgtttttacttgctgatgattcattgcacttccatctggtttgagcctttgttggccttcaccagcgcctccacttacgtactgctgaccccatagaggactatgctggagatattcctgatctctgaggctaggatgtaactggccttcatcgaatatggaatcatattccgaatccgattctagagctttttgagatcgtggaattgcgggtactgggaagtctactcccagatctgagtattcgccaccactttcaatatcggctactcgatgcatccgtgacaccactgctcttatggcatcgtctaattcttgcactgatgttaaata

SEQ ID NO: 1932 - DNA, 24 bp, Artificial Sequence
  Description of Artificial Sequence:  Synthetic Primer
gcgatactggtggtactggtgaag

SEQ ID NO: 1933 - DNA, 27 bp, Artificial Sequence
  Description of Artificial Sequence:  Synthetic Primer
ccatcctaatacgactcactatagggc

SEQ ID NO: 1934 - DNA, 23 bp, Artificial Sequence
  Description of Artificial Sequence:  Synthetic Primer
gaggtggttgtcttcagtggttg

SEQ ID NO: 1935 - DNA, 23 bp, Artificial Sequence
  Description of Artificial Sequence:  Synthetic Primer
actcactatagggctcgagcggc

SEQ ID NO: 1936 - DNA, 24 bp, Artificial Sequence
  Description of Artificial Sequence:  Synthetic Primer
caattttaaacgcatccacgaccg

SEQ ID NO: 1937 - DNA, 37 bp, Artificial Sequence
  Description of Artificial Sequence:  Synthetic Primer
ccgctcgagcgacccatttcacgacttatttgaatcg

SEQ ID NO: 1938 - DNA, 36 bp, Artificial Sequence
  Description of Artificial Sequence:  Synthetic Primer
ggaattctaaaatgcacaacaaaatcctggtcctgg

SEQ ID NO: 1939 - DNA, 40 bp, Artificial Sequence
  Description of Artificial Sequence:  Synthetic Primer
gactagtaaaatgggcgttaaaaatatatatttatactgc

SEQ ID NO: 1940 - DNA, 32 bp, Artificial Sequence
  Description of Artificial Sequence:  Synthetic Primer
ccgctcgaggtactgcacgtactaacgtcatc

SEQ ID NO: 1941 - DNA, 21 bp, Artificial Sequence
  Description of Artificial Sequence:  Synthetic Primer
gtctggaagctcaggaagagg

SEQ ID NO: 1942 - DNA, 24 bp, Artificial Sequence
  Description of Artificial Sequence:  Synthetic Primer
gtaatatgcgtgacaatcgtgtgg

SEQ ID NO: 1943 - DNA, 24 bp, Artificial Sequence
  Description of Artificial Sequence:  Synthetic Primer
cggtgcaagttatagaaccttccg

SEQ ID NO: 1944 - DNA, 32 bp, Artificial Sequence
  Description of Artificial Sequence:  Synthetic Primer
cgggatcccgaatatgctgacgtagatgtgtg

SEQ ID NO: 1945 - DNA, 32 bp, Artificial Sequence
  Description of Artificial Sequence:  Synthetic Primer
ggaattctgttttattctggttggtaacattc

SEQ ID NO: 1946 - DNA, 23 bp, Artificial Sequence
  Description of Artificial Sequence:  Synthetic Primer
gatatccactttgatcagcgcac

SEQ ID NO: 1947 - DNA, 21 bp, Artificial Sequence
  Description of Artificial Sequence:  Synthetic Primer
ggtactactcctggtgcgggc

SEQ ID NO: 1948 - DNA, 23 bp, Artificial Sequence
  Description of Artificial Sequence:  Synthetic Primer
ccgtcgacattaaactcaccatc

SEQ ID NO: 1949 - DNA, 22 bp, Artificial Sequence
  Description of Artificial Sequence:  Synthetic Primer
cgatcatgcgtctagcattggc

SEQ ID NO: 1950 - DNA, 23 bp, Artificial Sequence
  Description of Artificial Sequence:  Synthetic Primer
cccgccccagttctaggttgtcc

SEQ ID NO: 1951 - DNA, 20 bp, Artificial Sequence
  Description of Artificial Sequence:  Synthetic Primer
cacacccaacctgaccaggc

SEQ ID NO: 1952 - DNA, 31 bp, Artificial Sequence
  Description of Artificial Sequence:  Synthetic Primer
atggatccggcaaaatataccaaagaagaag

SEQ ID NO: 1953 - DNA, 30 bp, Artificial Sequence
  Description of Artificial Sequence:  Synthetic Primer
atgaattcttatattggtatcgcgtccatt

SEQ ID NO: 1954 - DNA, 24 bp, Artificial Sequence
  Description of Artificial Sequence:  Synthetic Primer
agtcgcatagtgcacttctgaatg

SEQ ID NO: 1955 - DNA, 22 bp, Artificial Sequence
  Description of Artificial Sequence:  Synthetic Primer
ctgacatctgtttccacagctc

SEQ ID NO: 1956 - DNA, 24 bp, Artificial Sequence
  Description of Artificial Sequence:  Synthetic Primer
aatagtgatgttgtaagagttagg

SEQ ID NO: 1957 - DNA, 29 bp, Artificial Sequence
  Description of Artificial Sequence:  Synthetic Primer
gtttaatattgcatgtttattcattaaaa

SEQ ID NO: 1958 - DNA, 21 bp, Artificial Sequence
  Description of Artificial Sequence:  Synthetic Primer
gcgccatgaagatttcaggcg

SEQ ID NO: 1959 - DNA, 23 bp, Artificial Sequence
  Description of Artificial Sequence:  Synthetic Primer
aagtgcaatgaatcatcagcaag

What is claimed is:

1. An isolated protein comprising SEQ ID NO:1873.
2. An isolated protein consisting of SEQ ID NO:1873.
3. A fragment of the isolated protein of claim 2, wherein said fragment is at least 50 amino acids in length.
4. A fragment of the isolated protein of claim 2, wherein said fragment is at least 100 amino acids in length.

* * * * *